US010987387B2

(12) United States Patent
Mulder et al.

(10) Patent No.: US 10,987,387 B2
(45) Date of Patent: Apr. 27, 2021

(54) COMPOSITIONS COMPRISING BACTERIAL STRAIN

(71) Applicant: 4D Pharma Research Limited, Aberdeen (GB)

(72) Inventors: Imke Elisabeth Mulder, Aberdeen (GB); Emma Raftis, Aberdeen (GB); Delphine Louise Claudette Caly, Aberdeen (GB); Emma Elizabeth Clare Hennessy, Aberdeen (GB)

(73) Assignee: 4D Pharma Research Limited, Aberdeen (GB)

( * ) Notice: Subject to any disclaimer, the term of this patent is extended or adjusted under 35 U.S.C. 154(b) by 0 days.

(21) Appl. No.: 16/691,136

(22) Filed: Nov. 21, 2019

(65) Prior Publication Data

US 2020/0147153 A1 May 14, 2020

Related U.S. Application Data

(63) Continuation of application No. PCT/GB2018/051417, filed on May 24, 2018.

(30) Foreign Application Priority Data

May 24, 2017 (GB) ...................................... 1708312
Jul. 14, 2017 (GB) ...................................... 1711369

(51) Int. Cl.
*A61K 35/744* (2015.01)
*A61P 35/00* (2006.01)
*A61K 9/00* (2006.01)

(52) U.S. Cl.
CPC ............ *A61K 35/744* (2013.01); *A61P 35/00* (2018.01); *A61K 9/0031* (2013.01); *A61K 9/0056* (2013.01)

(58) Field of Classification Search
CPC .. A61K 35/744; A61K 9/0031; A61K 9/0056; A61P 35/00
USPC ....................................................... 424/93.4
See application file for complete search history.

(56) References Cited

U.S. PATENT DOCUMENTS

| | | |
|---|---|---|
| 3,817,837 A | 6/1974 | Rubenstein et al. |
| 3,850,752 A | 11/1974 | Schuurs et al. |
| 3,939,350 A | 2/1976 | Kronick et al. |
| 3,996,345 A | 12/1976 | Ullman et al. |
| 4,275,149 A | 6/1981 | Litman et al. |
| 4,277,437 A | 7/1981 | Maggio |
| 4,366,241 A | 12/1982 | Tom et al. |
| 4,683,202 A | 7/1987 | Mullis |
| 4,816,567 A | 3/1989 | Cabilly et al. |
| 5,589,168 A | 12/1996 | Allen et al. |
| 5,599,795 A | 2/1997 | McCann et al. |
| 5,674,707 A | 10/1997 | Hintz et al. |
| 5,741,665 A | 4/1998 | Kato et al. |
| 5,925,657 A | 7/1999 | Seed et al. |
| 5,951,977 A | 9/1999 | Nisbet et al. |
| 6,348,452 B1 | 2/2002 | Brown et al. |
| 6,468,964 B1 | 10/2002 | Rowe et al. |
| 6,645,530 B1 | 11/2003 | Borody |
| 7,101,565 B2 | 9/2006 | Monte |
| 7,485,325 B2 | 2/2009 | Swain |
| 7,625,704 B2 | 12/2009 | Fredricks et al. |
| 7,749,494 B2 | 7/2010 | Renaud et al. |
| 7,998,474 B2 | 8/2011 | Kelly |
| 8,197,805 B2 | 6/2012 | Lin et al. |
| 8,287,932 B2 | 10/2012 | Rosales et al. |
| 8,460,648 B2 | 6/2013 | Borody |
| 8,557,233 B2 | 10/2013 | MacSharry et al. |
| 9,011,834 B1 | 4/2015 | McKenzie et al. |
| 9,314,489 B2 | 4/2016 | Kelly et al. |
| 9,371,510 B2 | 6/2016 | Moore |
| 9,376,473 B2 | 6/2016 | Gleiberman et al. |
| 9,539,293 B2 | 1/2017 | Kelly et al. |
| 9,610,307 B2 | 4/2017 | Berry et al. |
| 9,662,381 B2 | 5/2017 | Honda et al. |
| 9,796,762 B2 | 10/2017 | Kelly et al. |
| 9,808,519 B2 | 11/2017 | Honda et al. |
| 9,839,655 B2 | 12/2017 | Mulder et al. |
| 9,855,302 B2 | 1/2018 | Gajewski et al. |
| 9,937,211 B2 | 4/2018 | Kelly et al. |
| 9,974,815 B2 | 5/2018 | Mulder et al. |
| 9,987,311 B2 | 6/2018 | Mulder et al. |
| 10,046,015 B2 | 8/2018 | Mulder et al. |
| 10,058,574 B2 | 8/2018 | Grant et al. |
| 10,080,772 B2 | 9/2018 | Crouzet et al. |
| 10,086,020 B2 | 10/2018 | Bernalier-Donadille et al. |
| 10,086,021 B2 | 10/2018 | Jeffery et al. |
| 10,086,022 B2 | 10/2018 | Bernalier-Donadille et al. |
| 10,086,023 B2 | 10/2018 | Bernalier-Donadille et al. |
| 10,183,046 B2 | 1/2019 | Kelly |
| 10,226,489 B2 | 3/2019 | Patterson et al. |

(Continued)

FOREIGN PATENT DOCUMENTS

| | | |
|---|---|---|
| CA | 2768301 A1 | 1/2011 |
| CN | 1863540 A | 11/2006 |

(Continued)

OTHER PUBLICATIONS

Jan. 17, 2019 Notice of Allowance for U.S. Appl. No. 15/803,721.
Dec. 21, 2018 Notice of Allowance U.S. Appl. No. 15/700,700.
Jan. 30, 2019 Notice of Corrected Allowability for U.S. Appl. No. 15/803,721.
Jan. 30, 2019 Final Rejection for U.S. Appl. No. 15/842,635.
Feb. 1, 2019 Non-Final Office Action U.S. Appl. No. 16/040,356.
Mar. 4, 2019 Final Office Action for U.S. Appl. No. 15/704,245.
4d Pharma Plc: "Clinical Update—RNS—London Stock Exchange", Jul. 19, 2016.

(Continued)

*Primary Examiner* — Jennifer M. H. Tichy
(74) *Attorney, Agent, or Firm* — Wilson Sonsini Goodrich & Rosati

(57) ABSTRACT

The invention provides compositions comprising bacterial strains for treating and preventing cancer.

25 Claims, 2 Drawing Sheets
Specification includes a Sequence Listing.

(56) References Cited

U.S. PATENT DOCUMENTS

| | | | |
|---|---|---|---|
| 10,610,548 B2 | 4/2020 | Bernalier-Donadille et al. | |
| 10,610,549 B2 | 4/2020 | Crouzet et al. | |
| 2003/0147858 A1 | 8/2003 | Renaud et al. | |
| 2004/0005304 A1 | 1/2004 | Brudnak | |
| 2004/0106564 A1 | 6/2004 | Nilius et al. | |
| 2006/0062774 A1 | 3/2006 | Davis et al. | |
| 2006/0073161 A1 | 4/2006 | Breton | |
| 2006/0115465 A1 | 6/2006 | MacFarlane et al. | |
| 2007/0167423 A1 | 7/2007 | Bergauer et al. | |
| 2007/0258953 A1 | 11/2007 | Duncan et al. | |
| 2007/0286913 A1 | 12/2007 | Swain et al. | |
| 2008/0069861 A1 | 3/2008 | Brown et al. | |
| 2008/0206212 A1 | 8/2008 | McMahon et al. | |
| 2008/0260906 A1 | 10/2008 | Stojanovic | |
| 2008/0299098 A1 | 12/2008 | Se et al. | |
| 2009/0217401 A1 | 8/2009 | Korman et al. | |
| 2010/0028449 A1 | 2/2010 | Prakash et al. | |
| 2010/0047209 A1 | 2/2010 | Stanton et al. | |
| 2010/0086557 A1* | 4/2010 | Westphal-Daniel ... | A61K 35/74 424/172.1 |
| 2010/0247489 A1 | 9/2010 | Saur-Brosch | |
| 2010/0284973 A1 | 11/2010 | Schiffer-Mannioui et al. | |
| 2010/0303782 A1 | 12/2010 | Cobb et al. | |
| 2010/0311686 A1 | 12/2010 | Kasper et al. | |
| 2010/0316617 A1 | 12/2010 | Renaud et al. | |
| 2011/0053829 A1 | 3/2011 | Baumhof et al. | |
| 2011/0086011 A1 | 4/2011 | Kasper et al. | |
| 2011/0280840 A1 | 11/2011 | Blaser et al. | |
| 2012/0020943 A1 | 1/2012 | Lin | |
| 2012/0107279 A1 | 5/2012 | Arigoni et al. | |
| 2013/0022575 A1 | 1/2013 | Cassity | |
| 2013/0130988 A1 | 5/2013 | Blareau et al. | |
| 2013/0195802 A1 | 8/2013 | Moore | |
| 2013/0280724 A1 | 10/2013 | Ramadan et al. | |
| 2013/0316032 A1 | 11/2013 | Itoh et al. | |
| 2013/0336931 A1 | 12/2013 | Wadstrem et al. | |
| 2014/0037716 A1 | 2/2014 | Nowill et al. | |
| 2014/0056852 A1 | 2/2014 | Guglielmetti et al. | |
| 2014/0112897 A1 | 4/2014 | Pyne et al. | |
| 2014/0147425 A1 | 5/2014 | Henn et al. | |
| 2014/0154218 A1 | 6/2014 | Kohno et al. | |
| 2014/0179770 A1 | 6/2014 | Zhang et al. | |
| 2014/0193464 A1 | 7/2014 | Lin et al. | |
| 2014/0199281 A1 | 7/2014 | Henn et al. | |
| 2014/0227227 A1 | 8/2014 | Qin et al. | |
| 2014/0328803 A1 | 11/2014 | McKenzie et al. | |
| 2014/0335131 A1 | 11/2014 | Mazmanian et al. | |
| 2014/0341921 A1 | 11/2014 | Honda et al. | |
| 2014/0363397 A1 | 12/2014 | Allen-Vercoe et al. | |
| 2015/0044173 A1 | 2/2015 | Jones et al. | |
| 2015/0071957 A1 | 3/2015 | Kelly et al. | |
| 2015/0104418 A1 | 4/2015 | Flint et al. | |
| 2015/0132264 A1 | 5/2015 | Kelly et al. | |
| 2015/0284781 A1 | 10/2015 | Klumpp et al. | |
| 2016/0058804 A1 | 3/2016 | Jones et al. | |
| 2016/0067188 A1 | 3/2016 | Cade et al. | |
| 2016/0184370 A1 | 6/2016 | McKenzie et al. | |
| 2016/0199424 A1 | 7/2016 | Berry et al. | |
| 2016/0223553 A1 | 8/2016 | Sears et al. | |
| 2016/0235792 A1 | 8/2016 | Berry et al. | |
| 2017/0143772 A1 | 5/2017 | Mulder et al. | |
| 2017/0143773 A1 | 5/2017 | Mulder et al. | |
| 2017/0143774 A1 | 5/2017 | Mulder et al. | |
| 2017/0143775 A1 | 5/2017 | Mulder et al. | |
| 2017/0319634 A1 | 11/2017 | Grant et al. | |
| 2017/0326202 A1 | 11/2017 | Kelly | |
| 2017/0354695 A1 | 12/2017 | Grant et al. | |
| 2017/0360856 A1 | 12/2017 | Grant et al. | |
| 2017/0368110 A1 | 12/2017 | Grant et al. | |
| 2018/0072778 A1 | 3/2018 | Kelly et al. | |
| 2018/0078585 A1 | 3/2018 | Mulder et al. | |
| 2018/0078587 A1 | 3/2018 | Crott et al. | |
| 2018/0133265 A1 | 5/2018 | Stevenson | |
| 2018/0207207 A1 | 7/2018 | Bernalier-Donadille et al. | |
| 2018/0207208 A1 | 7/2018 | Jeffery et al. | |
| 2018/0214496 A1 | 8/2018 | Bernalier-Donadille et al. | |
| 2018/0221421 A1 | 8/2018 | Bernalier-Donadille et al. | |
| 2018/0250346 A1 | 9/2018 | Mulder et al. | |
| 2018/0271918 A1 | 9/2018 | Kelly et al. | |
| 2018/0344780 A1 | 12/2018 | Grant et al. | |
| 2018/0369293 A1 | 12/2018 | Jeffery et al. | |
| 2019/0000892 A1 | 1/2019 | Mulder et al. | |
| 2019/0015459 A1 | 1/2019 | Grant et al. | |
| 2019/0099458 A1 | 4/2019 | Grant et al. | |
| 2019/0134108 A1 | 5/2019 | Patterson et al. | |
| 2019/0134109 A1 | 5/2019 | Mulder et al. | |
| 2019/0151380 A1 | 5/2019 | Grant et al. | |
| 2019/0175666 A1 | 6/2019 | Mulder et al. | |
| 2019/0247448 A1 | 8/2019 | Grant et al. | |
| 2019/0255123 A1 | 8/2019 | Jeffery et al. | |

FOREIGN PATENT DOCUMENTS

| | | |
|---|---|---|
| CN | 1917946 A | 2/2007 |
| CN | 1954066 A | 4/2007 |
| CN | 101590081 A | 12/2009 |
| CN | 102304483 A | 1/2012 |
| CN | 102031235 B | 7/2012 |
| CN | 102093967 B | 1/2013 |
| CN | 102905558 A | 1/2013 |
| CN | 102940652 A | 2/2013 |
| CN | 102303172 B | 3/2013 |
| CN | 103037876 A | 4/2013 |
| CN | 103142656 A | 6/2013 |
| CN | 103146620 A | 6/2013 |
| CN | 103156888 A | 6/2013 |
| CN | 103652322 A | 3/2014 |
| CN | 103781487 A | 5/2014 |
| CN | 103820363 A | 5/2014 |
| CN | 103849590 A | 6/2014 |
| CN | 103865846 A | 6/2014 |
| CN | 103930117 A | 7/2014 |
| CN | 103981115 A | 8/2014 |
| CN | 103981117 A | 8/2014 |
| CN | 104160014 A | 11/2014 |
| CN | 104195075 A | 12/2014 |
| CN | 103509741 B | 2/2015 |
| CN | 102940652 B | 3/2015 |
| CN | 104435000 A | 3/2015 |
| CN | 103037876 B | 4/2015 |
| CN | 104546932 A | 4/2015 |
| CN | 104546933 A | 4/2015 |
| CN | 104546934 A | 4/2015 |
| CN | 104546935 A | 4/2015 |
| CN | 104546940 A | 4/2015 |
| CN | 104546942 A | 4/2015 |
| CN | 104560820 A | 4/2015 |
| CN | 105112333 A | 12/2015 |
| CN | 103820363 B | 2/2016 |
| CN | 103865846 B | 3/2016 |
| CN | 105982919 A | 10/2016 |
| DE | 19826928 A1 | 12/1999 |
| DE | 10206995 A1 | 9/2003 |
| EA | 201401117 A1 | 2/2015 |
| EP | 0120516 A2 | 10/1984 |
| EP | 0238023 A2 | 9/1987 |
| EP | 0433299 A1 | 6/1991 |
| EP | 0449375 A2 | 10/1991 |
| EP | 0581171 A1 | 2/1994 |
| EP | 0778778 A1 | 6/1997 |
| EP | 0888118 A1 | 1/1999 |
| EP | 0904784 A1 | 3/1999 |
| EP | 1141235 A2 | 10/2001 |
| EP | 1227152 A1 | 7/2002 |
| EP | 1383514 A1 | 1/2004 |
| EP | 1448995 A1 | 8/2004 |
| EP | 1481681 A1 | 12/2004 |
| EP | 1765391 A1 | 3/2007 |
| EP | 1958647 A1 | 8/2008 |
| EP | 1675481 B1 | 11/2008 |
| EP | 1997499 A1 | 12/2008 |
| EP | 1997905 A1 | 12/2008 |
| EP | 1997906 A1 | 12/2008 |
| EP | 1997907 A1 | 12/2008 |

(56) References Cited

FOREIGN PATENT DOCUMENTS

| | | |
|---|---|---|
| EP | 2044436 A2 | 4/2009 |
| EP | 2103226 A1 | 9/2009 |
| EP | 2133088 A3 | 1/2010 |
| EP | 1280541 B2 | 3/2010 |
| EP | 2236598 A1 | 10/2010 |
| EP | 2286832 A1 | 2/2011 |
| EP | 2308498 A1 | 4/2011 |
| EP | 2217253 B1 | 6/2011 |
| EP | 1940243 B1 | 8/2011 |
| EP | 2359838 A1 | 8/2011 |
| EP | 1855550 B1 | 10/2011 |
| EP | 1871400 B1 | 10/2011 |
| EP | 2124972 B1 | 6/2012 |
| EP | 1773361 B2 | 9/2012 |
| EP | 1945234 B1 | 12/2012 |
| EP | 2323493 B8 | 12/2012 |
| EP | 2323494 B8 | 12/2012 |
| EP | 1629850 B2 | 5/2013 |
| EP | 2203551 B1 | 8/2013 |
| EP | 2140771 B1 | 12/2013 |
| EP | 2687227 A1 | 1/2014 |
| EP | 2179028 B1 | 8/2014 |
| EP | 2650002 A4 | 8/2014 |
| EP | 2164349 B1 | 9/2014 |
| EP | 2134835 B1 | 10/2014 |
| EP | 2810652 A2 | 12/2014 |
| EP | 2305838 B1 | 1/2015 |
| EP | 2832859 A1 | 2/2015 |
| ES | 2408279 A2 | 6/2013 |
| JP | H08259450 A | 10/1996 |
| JP | 2003261453 A | 9/2003 |
| JP | 2005097280 A | 4/2005 |
| JP | 2006265212 A | 10/2006 |
| JP | 2007084533 A | 4/2007 |
| JP | 2007116991 A | 5/2007 |
| JP | 2008195635 A | 8/2008 |
| JP | 2009507023 A | 2/2009 |
| JP | 2010246523 A | 11/2010 |
| JP | 5031249 B2 | 9/2012 |
| JP | 2013005759 A | 1/2013 |
| JP | 5183848 B2 | 4/2013 |
| JP | 2013527240 A | 6/2013 |
| JP | 2013201912 A | 10/2013 |
| JP | 2014196260 A | 10/2014 |
| JP | 2014534957 A | 12/2014 |
| JP | 2015500792 A | 1/2015 |
| JP | 5710876 B2 | 4/2015 |
| JP | 5792105 B2 | 10/2015 |
| KR | 100468522 B1 | 1/2005 |
| KR | 20100128168 A | 12/2010 |
| KR | 1020100128168 | 12/2010 |
| KR | 101017448 B1 | 2/2011 |
| KR | 101057357 B1 | 8/2011 |
| KR | 20130021764 A | 3/2013 |
| KR | 101250463 B1 | 4/2013 |
| KR | 20140037544 A | 3/2014 |
| KR | 20140061328 A | 5/2014 |
| PL | 229020 B1 | 5/2018 |
| RU | 2078815 C1 | 5/1997 |
| TW | I417054 B | 12/2013 |
| WO | WO-8807865 A1 | 10/1988 |
| WO | WO-9117243 A1 | 11/1991 |
| WO | WO-9611014 A1 | 4/1996 |
| WO | WO-9720577 A1 | 6/1997 |
| WO | WO-9730717 A1 | 8/1997 |
| WO | WO-9735956 A1 | 10/1997 |
| WO | WO-9843081 A1 | 10/1998 |
| WO | WO-9855131 A1 | 12/1998 |
| WO | WO-9857631 A1 | 12/1998 |
| WO | WO-9919459 A1 | 4/1999 |
| WO | WO-9942568 A1 | 8/1999 |
| WO | WO-9945955 A1 | 9/1999 |
| WO | WO-0116120 A1 | 3/2001 |
| WO | WO-0158275 A2 | 8/2001 |
| WO | WO-0185187 A1 | 11/2001 |
| WO | WO-0193904 A1 | 12/2001 |
| WO | WO-0207741 A1 | 1/2002 |
| WO | WO-0242328 A2 | 5/2002 |
| WO | WO-02070670 A1 | 9/2002 |
| WO | WO-02085933 A1 | 10/2002 |
| WO | WO-02094296 A1 | 11/2002 |
| WO | WO-03010297 A1 | 2/2003 |
| WO | WO-03022255 A2 | 3/2003 |
| WO | WO-03045317 A2 | 6/2003 |
| WO | WO-03046580 A1 | 6/2003 |
| WO | WO-03053220 A2 | 7/2003 |
| WO | WO-2004003235 A3 | 6/2004 |
| WO | WO-2004085628 A1 | 10/2004 |
| WO | WO-2005007834 A1 | 1/2005 |
| WO | WO-2005030133 A2 | 4/2005 |
| WO | WO-2005032567 A2 | 4/2005 |
| WO | WO-2005058335 A1 | 6/2005 |
| WO | WO-2005032567 A3 | 7/2005 |
| WO | WO-2005093049 A1 | 10/2005 |
| WO | WO-2005107381 A2 | 11/2005 |
| WO | WO-2005121130 A2 | 12/2005 |
| WO | WO-2006012586 A2 | 2/2006 |
| WO | WO-2006033949 A1 | 3/2006 |
| WO | WO-2006033950 A1 | 3/2006 |
| WO | WO-2006033951 A1 | 3/2006 |
| WO | WO-2006102350 A1 | 9/2006 |
| WO | WO-2006102536 A2 | 9/2006 |
| WO | WO-2006091103 A3 | 10/2006 |
| WO | WO-2006110406 A2 | 10/2006 |
| WO | WO-2006130205 A1 | 12/2006 |
| WO | WO-2007027761 A2 | 3/2007 |
| WO | WO-2007056218 A2 | 5/2007 |
| WO | WO-2007064732 A1 | 6/2007 |
| WO | WO-2007064749 A1 | 6/2007 |
| WO | WO-2007098371 A2 | 8/2007 |
| WO | WO-2007136719 A2 | 11/2007 |
| WO | WO-2007140230 A3 | 2/2008 |
| WO | WO-2008031438 A3 | 5/2008 |
| WO | WO-2008055702 A1 | 5/2008 |
| WO | WO-2008055703 A2 | 5/2008 |
| WO | WO-2008064489 A1 | 6/2008 |
| WO | WO-2008073148 A2 | 6/2008 |
| WO | WO-2008076696 A2 | 6/2008 |
| WO | WO-2008053444 A3 | 7/2008 |
| WO | WO-2008083157 A2 | 7/2008 |
| WO | WO-2008134450 A2 | 11/2008 |
| WO | WO-2008153377 A1 | 12/2008 |
| WO | WO-2009027753 A1 | 3/2009 |
| WO | WO-2009030481 A1 | 3/2009 |
| WO | WO-2009055362 A1 | 4/2009 |
| WO | WO-2009059284 A2 | 5/2009 |
| WO | WO-2009072889 A1 | 6/2009 |
| WO | WO-2009079564 A2 | 6/2009 |
| WO | WO-2009043856 A3 | 7/2009 |
| WO | WO-2009080862 A1 | 7/2009 |
| WO | WO-2009100331 A2 | 8/2009 |
| WO | WO-2009116864 A1 | 9/2009 |
| WO | WO-2009128949 A2 | 10/2009 |
| WO | WO-2009138220 A1 | 11/2009 |
| WO | WO-2009149149 A1 | 12/2009 |
| WO | WO-2009151315 A1 | 12/2009 |
| WO | WO-2009154463 A1 | 12/2009 |
| WO | WO-2009156301 A1 | 12/2009 |
| WO | WO-2010002241 A1 | 1/2010 |
| WO | WO-2010036876 A2 | 4/2010 |
| WO | WO-2010037402 A1 | 4/2010 |
| WO | WO-2010037408 A1 | 4/2010 |
| WO | WO-2010037539 A1 | 4/2010 |
| WO | WO-2010048481 A1 | 4/2010 |
| WO | WO-2010063601 A1 | 6/2010 |
| WO | WO-2010081126 A3 | 9/2010 |
| WO | WO-2010129839 A1 | 11/2010 |
| WO | WO-2010130659 A1 | 11/2010 |
| WO | WO-2010130660 A1 | 11/2010 |
| WO | WO-2010130662 A1 | 11/2010 |
| WO | WO-2010130663 A1 | 11/2010 |
| WO | WO-2010130697 A1 | 11/2010 |
| WO | WO-2010130699 A1 | 11/2010 |
| WO | WO-2010130700 A1 | 11/2010 |

(56) References Cited

FOREIGN PATENT DOCUMENTS

| | | |
|---|---|---|
| WO | WO-2010130701 A1 | 11/2010 |
| WO | WO-2010130702 A1 | 11/2010 |
| WO | WO-2010130704 A1 | 11/2010 |
| WO | WO-2010130710 A1 | 11/2010 |
| WO | WO-2010130713 A1 | 11/2010 |
| WO | WO-2010/143940 A1 | 12/2010 |
| WO | WO-2010139531 A1 | 12/2010 |
| WO | WO-2010142504 A1 | 12/2010 |
| WO | WO-2010143961 A1 | 12/2010 |
| WO | WO-2010147714 A1 | 12/2010 |
| WO | WO-2010133475 A3 | 1/2011 |
| WO | WO-2011000620 A1 | 1/2011 |
| WO | WO-2011000621 A1 | 1/2011 |
| WO | WO-2011005756 A1 | 1/2011 |
| WO | WO-2010133472 A3 | 2/2011 |
| WO | WO-2011020748 A1 | 2/2011 |
| WO | WO-2011036539 A1 | 3/2011 |
| WO | WO-2011043654 A1 | 4/2011 |
| WO | WO-2011044208 A1 | 4/2011 |
| WO | WO-2011058535 A1 | 5/2011 |
| WO | WO-2011075138 A1 | 6/2011 |
| WO | WO-2011096808 A1 | 8/2011 |
| WO | WO-2011096809 A1 | 8/2011 |
| WO | WO-2011110918 A1 | 9/2011 |
| WO | WO-2011121379 A1 | 10/2011 |
| WO | WO-2011149335 A1 | 12/2011 |
| WO | WO-2011152566 A2 | 12/2011 |
| WO | WO-2011153226 A2 | 12/2011 |
| WO | WO-2011157816 A1 | 12/2011 |
| WO | WO-2012012874 A1 | 2/2012 |
| WO | WO-2012016287 A2 | 2/2012 |
| WO | WO-2012024638 A2 | 2/2012 |
| WO | WO-2011153226 A3 | 3/2012 |
| WO | WO-2012055408 A1 | 5/2012 |
| WO | WO-2012062780 A1 | 5/2012 |
| WO | WO-2012071380 A1 | 5/2012 |
| WO | WO-2012076739 A1 | 6/2012 |
| WO | WO-2012105312 A1 | 8/2012 |
| WO | WO-2012122478 A1 | 9/2012 |
| WO | WO-2012140636 A1 | 10/2012 |
| WO | WO-2012142605 A1 | 10/2012 |
| WO | WO-2012145491 A2 | 10/2012 |
| WO | WO-2012158517 A1 | 11/2012 |
| WO | WO-2012165843 A2 | 12/2012 |
| WO | WO-2012170478 A2 | 12/2012 |
| WO | WO-2013005836 A1 | 1/2013 |
| WO | WO-2013008039 A2 | 1/2013 |
| WO | WO-2013008102 A2 | 1/2013 |
| WO | WO-2013037068 A1 | 3/2013 |
| WO | WO-2013050792 A1 | 4/2013 |
| WO | WO-2013053836 A1 | 4/2013 |
| WO | WO-2013063849 A1 | 5/2013 |
| WO | WO-2013080561 A1 | 6/2013 |
| WO | WO-2013124725 A1 | 8/2013 |
| WO | WO-2013144701 A1 | 10/2013 |
| WO | WO-2013153358 A1 | 10/2013 |
| WO | WO-2013154725 A1 | 10/2013 |
| WO | WO-2013171515 A1 | 11/2013 |
| WO | WO-2013175038 A1 | 11/2013 |
| WO | WO-2013181694 A1 | 12/2013 |
| WO | WO-2013182038 A1 | 12/2013 |
| WO | WO-2014001368 A1 | 1/2014 |
| WO | WO-2014019271 A1 | 2/2014 |
| WO | WO-2014020004 A1 | 2/2014 |
| WO | WO-2014032108 A1 | 3/2014 |
| WO | WO-2014036182 A2 | 3/2014 |
| WO | WO-2014043593 A2 | 3/2014 |
| WO | WO-2014053076 A1 | 4/2014 |
| WO | WO-2014064359 A1 | 5/2014 |
| WO | WO-2014067976 A1 | 5/2014 |
| WO | WO-2014070014 A1 | 5/2014 |
| WO | WO-2014070225 A1 | 5/2014 |
| WO | WO-2014075745 A1 | 5/2014 |
| WO | WO-2014078911 A1 | 5/2014 |
| WO | WO-2014082050 A1 | 5/2014 |
| WO | WO-2014093622 A2 | 6/2014 |
| WO | WO-2014093635 A1 | 6/2014 |
| WO | WO-2014093655 A2 | 6/2014 |
| WO | WO-2014121298 A2 | 8/2014 |
| WO | WO-2014121301 A1 | 8/2014 |
| WO | WO-2014121302 A2 | 8/2014 |
| WO | WO-2014121304 A1 | 8/2014 |
| WO | WO-2014130540 A1 | 8/2014 |
| WO | WO-2014137211 A1 | 9/2014 |
| WO | WO-2014145958 A2 | 9/2014 |
| WO | WO-2014150094 A1 | 9/2014 |
| WO | WO-2014152338 A1 | 9/2014 |
| WO | WO-2014153194 A2 | 9/2014 |
| WO | WO-2014121302 A3 | 10/2014 |
| WO | WO-2014167338 A1 | 10/2014 |
| WO | WO-2014182966 A1 | 11/2014 |
| WO | WO-2014200334 A1 | 12/2014 |
| WO | WO-2014201037 A2 | 12/2014 |
| WO | WO-2015003001 A1 | 1/2015 |
| WO | WO-2015006355 A2 | 1/2015 |
| WO | WO-2015013214 A2 | 1/2015 |
| WO | WO-2015017625 A1 | 2/2015 |
| WO | WO-2015021936 A1 | 2/2015 |
| WO | WO-2015033305 A1 | 3/2015 |
| WO | WO-2015038731 A1 | 3/2015 |
| WO | WO-2015057151 A1 | 4/2015 |
| WO | WO-2015077794 A1 | 5/2015 |
| WO | WO-2015095241 A2 | 6/2015 |
| WO | WO-2015077794 A4 | 7/2015 |
| WO | WO-2015156419 A1 | 10/2015 |
| WO | WO-2015156519 A1 | 10/2015 |
| WO | WO-2015168534 A1 | 11/2015 |
| WO | WO-2015169944 A1 | 11/2015 |
| WO | WO-2015095241 A4 | 12/2015 |
| WO | WO-2016019506 A1 | 2/2016 |
| WO | WO-2016033439 A2 | 3/2016 |
| WO | WO-2016036615 A1 | 3/2016 |
| WO | WO-2016057671 A1 | 4/2016 |
| WO | WO-2016065324 A1 | 4/2016 |
| WO | WO-2016069795 A2 | 5/2016 |
| WO | WO-2016069801 A1 | 5/2016 |
| WO | WO-2016070151 A1 | 5/2016 |
| WO | WO-2016086161 A1 | 6/2016 |
| WO | WO-2016086205 A2 | 6/2016 |
| WO | WO-2016086206 A1 | 6/2016 |
| WO | WO-2016086208 A1 | 6/2016 |
| WO | WO-2016086209 A1 | 6/2016 |
| WO | WO-2016086210 A1 | 6/2016 |
| WO | WO-2016102950 A1 | 6/2016 |
| WO | WO-2016102951 A1 | 6/2016 |
| WO | WO-2016118730 A1 | 7/2016 |
| WO | WO-2016139217 A1 | 9/2016 |
| WO | WO-2016149449 A1 | 9/2016 |
| WO | WO-2016149687 A1 | 9/2016 |
| WO | WO-2016203218 A1 | 12/2016 |
| WO | WO-2016203220 A1 | 12/2016 |
| WO | WO-2017085520 A1 | 5/2017 |
| WO | WO-2017091753 A1 | 6/2017 |
| WO | WO-2017148596 A1 | 9/2017 |
| WO | WO-2018011594 A1 | 1/2018 |
| WO | WO-2018112363 A1 | 6/2018 |
| WO | WO-2018112365 A2 | 6/2018 |
| WO | WO-2018215782 A1 | 11/2018 |
| WO | WO-2019010255 A1 | 1/2019 |

OTHER PUBLICATIONS

4D Pharma:"4Dpharma PLC clinical update on blautix (TM), a novel treatment to irritable bowel syndrome," 4DPharma, Jan. 19, 2016, XP002769874, Retrieved from: https://www.directorstalkinterviews.com/4d-pharma-plc-clinical-update-on-blautix-a-novel-treatment-for-irritable-bowel-syndrome/412689588. [Retrieved on May 5, 2017].

Ahanchian, Hamic, A multi-strain synbiotic may reduce viral respiratory infections in asthmatic children: a randomized controlled trial; Sep. 2016, vol. 8, Issue 9, pp. 2833-2839, DOI: http://dxdoi.or/10.19082/2833.

(56) References Cited

OTHER PUBLICATIONS

Alp, G., and Aslim, B. (2010). Relationship between the resistance to bile salts and low pH with exopolysaccharide (EPS)production of *Bifidobacterium* spp. isolated from infants feces and breast milk. Anaerobe 16(2), 101-105. doi: 10.1016/j.anaerobe.2009.06.006. Epub Jul. 2, 2009.
Altschul et al. 'Basic local alignment search tool.' Journal of Molecular Biology. 1990, vol. 215, No. 3, pp. 403-410.Oct. 5, 1990.
"Amedei, A. et al. Multiple sclerosis: the role of cytokines in pathogenesis and in therapies. Int J Mol Sci. Oct. 19, 2012;13(10):13438-60. doi: 10.3390/ijms131013438."
Aminov et al. Molecular diversity, cultivation, and improved detection by fluorescent in situ hybridization of a dominant group of human gut bacteria related to *Roseburia* spp. or Eubacterium rectale. Applied and environmental microbiology. 2006, vol. 72, No. 9, pp. 6371-6376.
An et al. (1985) "New cloning vehicles fortransformation of higher plants," EMBO J. 4:277-284,Feb. 1, 1985.
An et al. (1988) "Binary Vectors," Plant Molecular Biology Manual. A3:1-19.
An et al. Transformation of Tobacco, Tomato,Potato, and *Arabiodopsis thaliana* Using a Binary Ti Vector System, Plant Physiol.May 1986; 81:301-305. PublishedMay 1986.
Angiolilli, Chiara et al., "Hisone deacetylase 3 regulates the inflammatory gene expression programme of rheumatoid arthritis fibroblast-like synoviocytes", Ann Rheum Dis, 2017, 76:277-285, Epub Jul. 25, 2016.
Anonymous: "4D pharma's Blautix for Irritable Bowel Syndrome shows positive impact—pharmaceutical daily news", Dec. 13, 2016.
Appleyard, Caroline B. et al., Pretreatment with the probiotic VSL#3 delays transition from inflammation to dysplasia in rate model of colitis-associated cancer; Am J. Physiol. Gastrointest. Liver Physiol. 301:G1004-G1013, 2011, Sep. 8, 2011:DOI:10.1152.ajpg.00167.2011.
Archer et al. (1997) "The Molecular Biology of Secreted Enzyme Production by Fungi," Critical Reviews Biotechnology. 17(4):273-306.
Arenberg, et al., Interferon-y-inducible Protein10 (IP-10) Is an Angiostatic Factor That Inhibits Human Non-small Cell Lung Cancer (NSCLC) Tumorigenesis and Spontaneous Metastases. 1996. J. Exp.Med.184:981-92. Sep. 1, 1996.
Atarashi et al. Induction of colonic regulatory T cells by indigenous *Clostridium* species. Science 331(6015):337-341 (2011).EpubDec. 23, 2010.
Atarashi et al., Th17 Cell Induction by Adhesion of Microbes to Intestinal Epithelial Cells. Cell, vol. 163, No. 2, Oct. 8, 2015. pp. 367-380.
Atarashi, et al., Treg induction by a rationally selected mixture of *Clostridia* strains from the human microbiota. Supplementary Information. Nature 500, 232-236 (Aug. 8, 2013) doi:10.1038/nature12331.
Atarashi, K. et al., Treg induction by arationally selected mixture of *Clostridia* strains from the human microbiota.Nature. 2013; 500(7461):232-236. Epub Jul. 10, 2013.
ATCC Catalog, https://www.atcc.org/search_results.aspx?dsNav=Ntk:primarysearch%7cbacteroides+thetaiotaomicron%7c3%7c,Ny:true,ro:0,N:1000552&searchterms=bacteroides+thetaiotaomicron&redir=1, Accessed on May 2, 2018.
Ausubel et al. (1999) Short Protocols in Molecular Biology. 4th edition. pp. 7-58 to 7-60, and Chapter 18. pp. 18-1 to 18-23.
Awadel-Kariem, Mustafa et al., First report of Parabacteroides goldsteinii bacteraemia in a patient with complicated intra-abdominal infection, Anaerobe, vol. 16, Issue 3, Jun. 2010, pp. 223-225. Epub Feb. 6, 2010.
Azad, M.B. et al., Probiotic supplementation during pregnancy or infancy for the prevention of asthma and wheeze: systematic review and meta-analysis BMJ 2013; 347 :f6471, Dec. 4, 2013.
Aziz, R.K., Bartels, D., Best, A.A., DeJongh, M., Disz, T., Edwards, R.A., et al. (2008). The RAST Server: Rapid Annotations using Subsystems Technology. BMC Genomics 9, 75. doi: 10.1186/1471-2164-9-75. Published: Feb. 8, 2008.
Bagge, et al., Diversity of spore-formingbacteria in cattle manure, slaughterhouse waste and samples from biogas plants.Journal of applied microbiology. 2010;109: 1549-1565. Epub Jul. 13, 2010.
Balato, et al., Effects of adalimumab therapy in adult subjects with moderate-to-severe psoriasis on Th17 pathway. (2014) J Eur Acad Dermatol Venereol. 28(8):1016-24. Epub Sep. 4, 2013.
Banfield, J. & Murphy, K.R., Non-Th2, Late-onset, non-allergic asthma. Copd & Asthma for NPs, A peer-reviewed newsletter, Aug. 2016; 14: 8 Pages.
Barcenilla, et al. Phylogenetic relationships of butyrate-producing bacteria from the human gut. Appl Environ Microbiol. Apr. 2000. 66(4):1654-61.
Barry, et al., Criteria for Disksusceptibility tests and quality control guidelines for the cefoperazone-sulbactam combination, Journal of clinical microbiology, Jan. 1988;26(1):13-17.
Beaucage, et al. Deoxynucleoside phosphoramidites—A new class of key intermediates for deoxypolynucleotide synthesis. Tetrahedron Letters, vol. 22, 1981, pp. 1859-1869.
Beggs (1978) "Transformation of yeast by areplicating hybrid plasmid," Nature. 275:104-109. Published: Sep. 1, 1978.
Begley, M., Hill, C., and Gahan, C.G.M. (2006). Bile Salt Hydrolase Activity in Probiotics. Applied and Environmental Microbiology 72(3), 1729-1738. doi: 10.1128/AEM.72.3.1729-1738.2006.
Berg et al. (1996) "Enterocolitis and colon cancer in interleukin-10-deficient mice are associated with aberrant cytokine production and CD4(+) TH1-like responses," The Journal of Clinical Investigation. 98(4):1010-1020.Aug. 15, 1996.
Berger, B., Moine, D., Mansourian, R., and Arigoni, F. (2010). HspR Mutations Are Naturally Selected in Bifidobacterium longum When Successive Heat Shock Treatments Are Applied. Journal of Bacteriology 192(1), 256-263. doi: 10.1128/jb.01147-09.
Berger, S. Gideon guide to medically important bacteria. Gideon E-book Series. 2017 edition. 4 pages.
Bergonzelli, G.E., Granato, D., Pridmore, R.D., Marvin-Guy, L.F., Donnicola, D., and Corthesy-Theulaz, I.E. (2006). GroEL of Lactobacillus johnsonii La1 (NCC 533) is cell surface associated: potential role in interactions with the host and the gastric pathogen Helicobacter pylori. Infect Immun 74(1), 425-434. doi: 10.1128/IAI.74.1.425-434.2006.
Bernalier, A., et al., "Diversity of H2/C02-utilizing acetogenic Bacteria from Feces of Non-Methane-Producing Humans", Current Microbiology vol. 33 (Aug. 1996), pp. 94-99, Springer-Vertag New York Inc., USA.
Bernalier et al., "Acetogenesis from H02 and C0-2 by Methane and Non-Methane-Producing Human Colonic Bacterial Communities" Fems Microbiology Ecology. vol. 19. No. 3. 1996. pp. 193-202. XP000979130.
Bernalier et al. *Ruminococcus hydrogenotrophicussp.* nov., a new H2/CO2-utilizing acetogenic bacterium isolated from humanfeces. 1996 Arch. Microbiol. 166 (3), 176-183. Sep. 1996.
Bertram, J. et al. Establishment of a cloned line of Lewis lung carcinoma cells adapted to cell culture. (1980) Cancer let. 11:63-73.
Blandino, G., Fazio, D., DiMarco, R. Probiotics: Overview of microbiological and immunological characteristics (2008). Expert Review of Anti-Infective Therapy, 6 (4), pp. 497-508.
Bond, John H., Jr., et al., "FactorsInfluencing Pulmonary MethaneExcretion in Man: An indirect method of studying the in situ metabolism of themethane-producing colonic bacteria"; Journal of Experimental Medicine, Mar. 1, Mar. 1, 1971;133(3):pp. 572-588.
Born, P., et al., English Abstract "Carbohydrate substitutes: comparative study of intestinal absorption of fructose, sorbitol and xylitol", "Zuckeraustauschstoffe: Vergleichende Untersuchung zur intestinalen Resorption von Fructose, Sorbit and Xylit", Medizinische Klinik 89, Technischen Universitat Munchen (Munich) Nov. 15, 1994; 89 (11): 575-8 (Article in German), Urban & Vogel, Munich, Germany.
Born, P., et al., "Fecal bacterial activity in symptomatic carbohydrate malabsorption: Effect on the fecal short-chain fatty acid ratio", intervention during the week "Digestive Diseases Week" from May 16 to May 19, 1999, Orlando, Z. Gasteroenterol2000: 38:623-626, Georg Thieme Verlag Stuttgart, New York, USA.

(56) References Cited

OTHER PUBLICATIONS

Bottacini, F., Morrissey, R., Esteban-Torres,M., James, K., van Breen, J., Dikareva, E., et al. (2018). Comparative genomicsand genotype-phenotype associations in Bifidobacterium breve. Scientific Reports 8(1), 10633. doi: 10.1038/s41598-018-28919-4. Published: Jul. 13, 2018.
Bottacini, F., O'Connell Motherway, M., Kuczynski, J., O'Connell, K.J., Serafini, F., Duranti, S., et al. (2014). Comparative genomics of the Bifidobacterium breve taxon. BMC Genomics 15(1), 170. doi: 10.1186/1471-2164-15-170.Published:Mar. 1, 2014.
Brand et al., Collagen-induced arthritis, 2007; Protocol 2(5):1269-1275.
Brasel et al. (2000) "Generation of murine dendritic cells from ftl3-ligand-supplemented bone marrow cultures," Blood. 96(9):3029-3039.
Bressa, et al., Differences in gut microbiota profile between women with active lifestyle and sedentary women. Plos One, 2017; 12(2): 1-20. Feb. 10, 2017.
Brook, I., Clinical Review: Bacteremia caused by anaerobic bacteria in children. Critical Care 6(3): 7 pages (2002)Publishedonline May 9, 2002.
Bry et al. A model of host-microbial interactions in an open mammalian ecosystem. Science 273(5280):1380-1383(1996). Sep. 6, 1996.
Buffie et al., Precision microbiome restoration of bile acid-mediated resistance to Clostridium difficile. Nature,517(7533):205-208 (2015). Published online Oct. 22, 2014.
Busing, K. et al., Effects of oral Enterococcus faecium strain DSM 10663 NCIMB 10415 on diarrhoea patterns and performance of sucking piglets. Benef Microbes. Mar. 2015;6(1):41-4. doi: 10.3920/BM2014.0008.
Butcher et al. (1980) The role of tissue culture in the study of crown-gall tumorigenesis. Tissue Culture Methods for Plant Pathologists. Eds.: Ingrams, D. S.; Helgeson, J.P. pp. 203-208.
"Campeau, J.L. et al., IntestinalEpithelial Cells Modulate Antigen-Presenting Cell Responses to Bacterial DNA. Infection and Immunity. Aug. 2012; 80(8): 2632-2644."
Candela et al. 'Interaction of probiotic Lactobacillusand Bifidobacterium strains with human intestinal epithelial cells: Adhesion properties, competitionagainst enteropathogens and modulationof IL-8 production'. International Journal of Food Microbiology. 2008,vol. 125, No. 3, pp. 286-292. EpubApr. 30, 2008.
Candela, M., Bergmann, S., Vici, M., Vitali, B., Turroni, S., Eikmanns, B.J., et al. (2007). Binding of human plasminogen to Bifidobacterium. J Bacteriol 189(16), 5929-5936. doi: 10.1128/JB.00159-07.Epub Jun. 8, 2007.
Candela, M., Biagi, E., Centanni, M., Turroni, S., Vici, M., Musiani, F., et al. (2009). Bifidobacterial enolase, a cell surface receptor for human plasminogen involved in the interaction with the host. Microbiology 155(Pt 10), 3294-3303. doi: 10.1099/mic.0.028795-0.EpubJul. 2, 2009.
Candela, M., Centanni M Fau—Fiori, J., Fiori J Fau—Biagi, E., Biagi E Fau—Turroni, S., Turroni S Fau—Orrico, C., Orrico C Fau—Bergmann, S., et al. (2010). DnaK from *Bifidobacterium animalis* subsp. lactis is a surface-exposed human plasminogen receptor upregulated in response to bile salts. Microbiology 156(6), 1609-1618.
Caruthers, et al. New chemical methods for synthesizing polynucleotides. Nucleic Acids Symp Ser. 1980;(7):215-23.
Carvalho et al. (Jan. 2011) "TLR5activation induces secretory interleukin-1 receptor antagonist (sIL-1Ra) andreduces inflammasome-associated tissue damage," Mucosal Immunol. 4(1):102-111. Published onlineSep. 15, 2010.
Casey et al. 'Isolation and characterization of anti-*Salmonella* lactic acid bacteria from the porcine gastrointestinal tract'. Letters in Applied Microbiology. 2004, vol. 39, No. 5, pp. 431-438.
Caspi, P.R. Experimental autoimmune uveoretinitis in the rat and mouse. Curr Protoc Immunol. May 2003;Chapter 15:Unit 15.6. doi: 10.1002/0471142735.im1506s53.

Cekanaviciute, et al., Gut bacteria from multiple sclerosis patients modulate human T cells and exacerbate symptoms in mouse models. PNAS. Received for review Jun. 30, 2017; 1-6. Oct. 3, 2017 114 (40) 10713-10718; first published Sep. 11, 2017.
Cereghino et al. (2000) "Heterologous protein expression in the methylotrophic yeast *Pichia pastoris*," FEMS Microbiol Review. 24(1 ):45-66.
Charriot, et al., Future treatment for asthma, Eur Respir Rev 2016; 25: 77-92.
Cheluvappa, R. et al., T helper type 17 pathway suppression by appendicitis and appendectomy protects against colitis. Clin Exp Immunol. Feb. 2014;175(2):316-22. doi: 10.1111/cei.12237.
Chen D.K. et al. "Evaluation of D-xyloseand 1% methyl-alpha-D-glucopyranoside Fermentation Tests for Distinguishing Enterococ-cusGallinarum From Enterococcus Faecium". J. Clin. Microbiol. Oct. 2000, 38(10): 3652-3655;PMID: 11015378.
Chen, S. et al., Live combined bacillus subtilis and enterococcus faecium ameliorate murine experimental colitis by immunosuppression. International journal of inflammation. 2014(878054). 7 Pages. Published online Sep. 8, 2014.
Chevreux et al. 'Genome sequence assembly using trace signals and additional sequence information.' German Conference on Bioinformatics. 1999.
Chi, W. et al., IL-23 promotes CD4+ T cells to produce IL-17 in Vogt-Koyanagi-Harada disease. J Allergy Clin Immunol. May 2007;119(5):1218-24. Epub Mar. 1, 2007.
Chi, W. et al. Upregulated IL-23 and IL-17 in Behçet patients with active uveitis. Invest Ophthalmol Vis Sci. Jul. 2008;49(7):3058-64. doi: 10.1167/iovs.07-1390.
Chiu, et al., Monocolonization of germ-free mice with bacteroides fragilis protects against dectran sulfate sodium-induced acute colitis. Biomed Research International 2014. vol. 2014. Article ID 675786. 9 Pages.May 29, 2014.
Choji Kaneuchi et al., "*Clostridium coccoides*, a New Species from the Feces of Mice", International Journal of Systematic Bacteriology, vol. 26, No. 4, Oct. 1976, p. 482-486.
Chothia et al. The relation between the divergence of sequence and structure in proteins. EMBO Journal. 1986, 5(4):823-826.
Christiaen, S.E., O'Connell Motherway, M.,Bottacini, F., Lanigan, N., Casey, P.G., Huys, G., et al. (2014). Autoinducer-2plays a crucial role in gut colonization and probiotic functionality of Bifidobacterium breve UCC2003. PLoS One 9(5), e98111. doi: 10.1371/journal.pone.0098111.Published: May 28, 2014.
Christmann, et al., Human seroreactivity to gut microbiota antigens. J Allergy Clin Immunol 136(5):1378-1386; available online May 23, 2015.
Christou (1994) "Genetic engineering of crop legumes and cereals: current status and recent advances," Agro-Food Industry Hi-Tech. pp. 17-27.
Chung et al. 'Microbiota-stimulated immune mechanisms to maintain gut homeostasis.' Current Opinion in Immunology. 2010, vol. 22, No. 4, pp. 455-460. EpubJul. 23, 2010.
Cintas LM, Casaus MP, Herranz C, Nes IF, Hernandez PE. Review: bacteriocins of lactic acid bacteria (2001). Food Sci Technol 7(4):281-305.
Claesson, et al. Gut microbiota composition correlates with diet and health in the elderly. 2012. Nature, 488, 178-184. Published: Jul. 13, 2012.
Clarridge III, J.E. Impact of 16S rRNA gene sequence analysis for identification of bacteria on clinical microbiology and infectious diseases (2004). Clinical Microbiology Reviews, 17 (4), pp. 840-862.
Clinical Trials for Thetanix, EU Clinical Trials Register, Date of commencement of clinical trial: Oct. 16, 2015. Available at: https://clinicaltrialsregister.eu/ctr-search/search?query=Thetanix.
Coakley M et al: Intestinal bifidobacteria that produce trans-9, trans-11 conjugated linoleicacid: A fatty acid with antiproliferative activity against human colon SW480and HT-29 cancer cells, Nutrition and Cancer, Taylor & Francis Group, US vol. 56, No. 1, Jan. 1, 2006 (Jan. 1, 2006), pp. 95-102, XP008087265, ISSN: 0163-5581, DOI:10.1207/515327914NC5601 13 cf. abstract, p. 101, last para. of the right-hand col.

(56) References Cited

OTHER PUBLICATIONS

Colin, et al., GIC-1001, A Clinical Stage, Orally Administered Colonic Analgesic Drug Proposed as a Cost-Effective Alternative to I.V. Sedation Used in Colonoscopy. Canadian Digestive Diseases Week, 2014; 2 pages.

Collins, M.D., et al., *Enterococcus avium* nom.rev., comb. nov.; *E. casseliflavus* nom. rev., comb. nov.; *E. durans* nom. rev.,comb. nov.; *E. gallinarum* comb. nov.; and *E. malodoratus* sp. nov. (1984) Int JSyst Evol Microbiol. 34: 220-223. First Published: Apr. 1, 1984. irst Published: Apr. 1, 1984.

Constantinescu et al. Experimental autoimmune encephalomyelitis (EAE) as a model for multiple sclerosis (MS). 2011. Br J Pharmacol. 164(4):1079-1106.

Cotter, P.O., Hill, C., Ross, R.P. Food microbiology: Bacteriocins: Developing im1ate immunity for food (2005). Nature Reviews Microbiology, 3 (10), pp. 777-788.

Crellin et al. (2005) "Human CD4+ T cells express TLR5 and its ligand ftagellin enhances the suppressive capacity and expression of FOXP3 in CD4+CD25+ T regulatory cells," Journal of Immunology. 175(12):8051-8059.

Cronin, M., Knobel, M., O'Connell-Motherway, M., Fitzgerald, G.F., and van Sinderen, D. (2007). Molecular Dissection of a Bifidobacterial Replicon. Applied and Environmental Microbiology 73(24), 7858-7866.

Cummings, M., Breitling, R., and Takano, E.(2014). Steps towards the synthetic biology of polyketide biosynthesis. FemsMicrobiology Letters 351(2), 116-125. doi: 10.1111/1574-6968.12365. Epub Jan. 7, 2014.

Dahya V. et al., Clostridium ramosum Osteomyelitis in an immunocompetent patient after traumatic injury, Infectious Diseases in Clinical Practice Mar. 12, 2015 Lippincott Williams and Wilkins USA, vol. 23, No. 2, Mar. 12, 2015, pp. 102-104, XP009193312, ISSN: 1056-9103 the whole document.

Daniel Garrido et al., "Utilization of galactooligosaccharides by *Bifidobacterium longum* subsp. infantis isolates", Food Microbiology, 33 (2013) 262-270, Epub Oct. 22, 2012.

Darfeuille-Michaud et al. High prevalence of adherent-invasive *Escherichia coli* associated with ileal mucosa in Crohn's disease. . 2004. Gastroenterology 127(2):412-21.

Darlington, G.J., Liver Cell Lines. (1987) Meth Enzymol. 151:19-38.

Database UniProt [Online] Jun. 1, 2003 (Jun. 1, 2003), "subname:Full= possible pirin family protein {ECO:0000313|EMBLAAO75294. 1};", XP00275366,retrieved from EBI accession No. UNIPROT:Q8ABC3 Database accession No. Q8ABC3.

Database WPI, Week 201801, Thomson Scientific, London, GB; AN 2017-834299, XP002787097, & WO 2017/209156 AI (Morinaga Milk Ind Co. Ltd) Dec. 7, 2017 (Dec. 7, 2017)* abstract * of WO2017/2019156, Kobayashi, Youdai et al.

Davis et al., Genetic and Microbiological Research Techniques, Methods Enzymol. 1970; 17A:79-143.

De Paepe et al. 'Trade-off between bile resistance and nutritional competence drives *Escherichia coli* diversification in the mouse gut.' PLoS Genetics. 2011, vol. 7, No. 6, e1002107. Published:Jun. 16, 2011.

De Ruyter, P.G., Kuipers, O.P., and de Vos, W.M. (1996). Controlled gene expression systems for Lactococcus lactis with the food-grade inducer nisin. Applied and Environmental Microbiology 62(10), 3662-3667.

Deangelis, M., et al., Selection of potential probiotic lactobacilli from pig feces to be used as additives in pelleted feeding (2006). Research in Microbiology, 157 (8), pp. 792-801. Epub Jun. 23, 2006.

Delgado, S., Ruiz, L., Hevia, A., Ruas-Madiedo, P., Margolles, A., and Sánchez, B. (2018). "Evidence of the In Vitro and In Vivo Immunological Relevance of Bifidobacteria," in the Bifidobacteria and Related Organisms.), 295-305.

Demarche, et al., Detailed analysis of sputum and systemic inflammation in asthma phenotypes: are paucigranulocytic asthmatics really non-inflammatory?, BMC Pulmonary Medicine, 2016; (16)46: 1-13. Published:Apr. 5, 2016.

Dennis et al. 'DAVID: database for annotation, visualization, and integrated discovery.' Genome Bioi. 2003, vol. 4, No. 5, pp. 3.Published:Aug. 14, 2003.

Dheeraj Mohania et al., "Modulation of expression of Programmed Death-1 by administration of probiotic Dahi in DMH-induced colorectal carcinogenesis in rats", Acta Biomed 2013; 84: 102-109, Sep. 1, 2013.

Distrutti, et al., 5-Amino-2-hydroxybenzoic Acid 4-(5-Thioxo-5H-[1,2]dithiol-3yl)-phenyl Ester (ATB-429), a Hydrogen Sulfide-Releasing Derivative of Mesalamine, Exerts Antinociceptive Effects in a Model of Postinflammatory Hypersensitivity. The Journal of pharmacology and experimental therapeutics, 2006;319(1):447-458. Epub Jul. 19, 2006.

Distrutti, et al., Gut Microbiota role in irritable bowel syndrome: New therapeutic strategies. World Journal of Gastroenterology. Feb. 21, 2016; 22(7): p. 2219-2241, XP002769875.

Distrutti, et al., Hydrogen sulphide induces u opioid receptor-dependent analgesia in a rodent model of visceral pain. Molecular Pain, 2010; 6(36):1-16.

Divyashri et al. Probiotic attributes, antioxidant, anti-inflammatory and neuromodulatory effects of Enterococcus faecium CFR 3003: in vitro and in vivo evidence. (2015) J Med Microbiol. doi: 10.1099/jmm.0.000184. Dec. 2015;64(12):1527-1540. Epub Oct. 7, 2015.

DMSZ: Opening of Ampoules and Rehydration of Dried Cultures; (http://web.archive.org/web/20000 52411541 O/www.dsmz.de/open. htm); updated of website on Mar. 2000.

Dong, H., Rowland I Fau—Yacioob, P., and Yaqoob, P. (2012). Comparative effects of six probiotic strains on immune function in vitro. Br J Nutr 108(3), 459-470. doi: 10.1017/S0007114511005824. Epub Nov. 7, 2011.

Dong-Hyun Kim and Young-Ho Jin, "Intestinal Bacterial B-Glucuronidase Activity of Patients with Colon Cancer", Arch Pharm Res vol. 24, No. 6, 564-567, 2001,Published:Dec. 2001.

Drago, Lorenzo et al., Immunodulatory Effects of Lactobucillus salivarius LS01 and Bifidobacterium breve, Alone and in Combination on Peripheral Blood Mononuclear Cells of Allergic Asthmatics; Allergy Asthma Immunol. Res. Jul. 2015: 7(4):409-413. Published online Mar. 18, 2015.

Duck et al. 'Isolation of flagellated bacteria implicated in Crohn's disease.' Inflammatory Bowel Diseases. 2007, vol. 13, No. 10, pp. 1191-1201.

Duncan et al. (2006) "Proposal of *Roseburia faecis* sp. nov., *Roseburia hominis* sp. nov. and *Roseburia inulinivorans* sp. nov., based on isolates from human faeces," International Journal of Systematic and Evolutionary Microbiology. vol. 56, No. Pt 10, pp. 2437-2441. First Published: Oct. 1, 2006.

Duncan et al. "Lactate-utilizing bacteria, isolated from human feces, that produce butyrate as a major fermentation product" Applied and environmental microbiology. 2004, vol. 70, No. 10, pp. 5810-5817.

Duncan, et al. *Roseburia intestinalis* sp. nov., a novel saccharolytic, butyrate-producing bacterium from human faeces. Int J Syst Evol Microbiol. Sep. 2002;52(Pt 5):1615-20.

Durand et al., "Reductive Acetogenesis in Animal and Human Gut." Physiological and Clinical Aspects of Short-Chain Fatty Acids, 1995. pp. 107-117, XP000979817 Cambridge University Press ISBN 0-521-44048-3.

Eckburg, PB. et al., Diversity of the human intestinal microbial flora.Science. Jun. 10, 2005;308(5728):1635-8. Epub Apr. 14, 2005.

Elhenawy et al., Preferential packing of acidic glycosidases and proteases into bacteroides Outer membrane vesicles. mBio 5:e00909-14, pp. 1-12, 2014.

Elkins et al. 'Genes encoding bile salt hydrolases and conjugated bile salt transporters in Lactobacillus johnsonii 100-100 and other *Lactobacillus* species.' Microbiology. 2001, vol. 147, No. 12, pp. 3403-3412.

Elmadfa, 1., Klein, P., Meyer, AL. Immune-stimulating effects oflactic acid bacteria in vivo and in vitro (2010). Proceedings of the Nutrition Society, 69 (3), pp. 416-420. Epub Jun. 16, 2010.

(56) References Cited

OTHER PUBLICATIONS

Ely et al. (2000) "A family of six flagellin genes contributes to the Caulobacter crescentus flagellar filament," Journal of Bacteriology. 182(17):5001-5004.
Embl sequence AA075294.1 (2003)—provided within the Office Action dated Feb. 16, 2018 in U.S. Appl. No. 15/631,952. 2 Pages.
Eren, A. Murat et al., "A single genus in the gut microbiome reflects host preference and specificity," The ISME Journal (2015) 9, 9-100 (2015).
ESR Dated Dec. 17, 2018, Appl. 18189521.0.
Estelle Devillard et al., Metabolism of Linoleic Acid by Human Gut Bacteria: Different Routes for Biosynthesis of Conjugated Linoleic Acid, Journal of Bacteriology, Mar. 2007, vol. 189, No. 4, pp. 2566-2570, EpubJan. 5, 2007.
Eurasian Search Report dated May 23, 2020 for ApplicationSerial No. 202090107 (8 pages).
European Communication dated Jun. 14, 2017 for EP Application No. 15817513.3.
Evelo Biosciences, Inc. Clinical Trials (Rank 1): A Study of EDP1503 in Patients With Colorectal Cancer, Breast Cancer, and Checkpoint Inhibitor Relapsed Tumors, https://clinicaltrials.gov/ct2/show/NCT03775850?spons=evelo&rank=1, 2018, accessed on Feb. 4, 2019.
Evelo Biosciences, Inc. Clinical Trials (Rank 2): A Study of EDP1815 in Healthy Participants and Participants With Mild to Moderate Psoriasis and Atopic Dermatitis, https://clinicaltrials.gov/ct2/show/NCT03733353?spons=evelo&rank=2, 2018, accessed on Feb. 4, 2019.
Evelo Biosciences, Inc. Clinical Trials (Rank 3): A Study of EDP1066 in Healthy Participants and Participants With Mild to Moderate Psoriasis and Atopic Dermatitis, https://clinicaltrials.gov/ct2/show/NCT03542994?spons=evelo&rank=3, 2018, accessed Feb. 4, 2019.
Evelo Biosciences, Inc. Clinical Trials (Rank 4): Pembrolizumab and EDP1503 in Advanced Melanoma, https://clinicaltrials.gov/ct2/show/NCT03595683?spons=evelo&rank=4, 2018, accessed Feb. 4, 2019.
Evelo Biosciences, Inc. Portfolio: https://evelobio.com/portfolio/, accessed Feb. 4, 2019.
Evelo Biosciences, Inc. website: https://evelobio.com/science/, accessed Feb. 4, 2019.
Extended European search report and opinion dated Aug. 23, 2016 for EP Application No. 16166001.4.
Fabro, A. et al., the Th17 pathway in the peripheral lung micro environment interacts with expression of collagen V in the late state of experimental pulmonary fibrosis. (2015) Immunobiology. 220(1):124-35. EpubAug. 18, 2014.
Faghih, Z. et a., IL-17 and IL-4 Producing CD8+ T Cells in Tumor Draining Lymph Nodes of Breast Cancer Patients: Positive Association with Tumor Progression. (2013). Iranian Journal of Immunology. 10(4):193-204.
Fahy, J.V. Eosinophilic and neutrophilic inflammation in asthma: insights from clinical studies. Proc Am Thorac Soc. May 1, 2009;6(3):256-9. doi: 10.1513/pats.200808-087RM.
Faith et al. Identifying gut microbe-host phenotype relationships using combinatorial communities in gnotobiotic mice. Sci Transl Med 6(220):220ra11 (2014).
Faith et al. The long-term stability of the human gut microbiota. 2013. Science, 341(6141): 1237439.
Falony, et al., Coculture Fermentations of *Bifidobacterium* species and bacteroides thetaiotaomicron Reveal a mechanistic insight into the prebiotic effect of inulin-type Fructans. Applied and environmental microbiology, Apr. 2009;75(8):2312-2319,Epub200.
Falony et al. In vitro kinetics of prebiotic inulin-type fructan fermentation by butyrate-producing colon bacteria: Implementation of online gas chromatography for quantitative analysis of carbon dioxide and hydrogen gas production. Applied and Environmental Microbiology. 2009, vol. 75, No. 18, pp. 5884-5892. EpubJul. 24, 2009.
Fanning, S., Hall, L.J., Cronin, M., Zomer, A., MacSharry, J., Goulding, D., et al. (2012). Bifidobacterial surface-exopolysaccharide facilitates commensal-host interaction through immune modulation and pathogen protection. Proc Natl Acad Sci U S A 109(6), 2108-2113. doi: 10.1073/pnas.1115621109.
Farmer, et al., Gut pain & visceral hypersensitivity. British journal of pain, 2013;7(1):39-47.
Farooq, P.D. et al., Pseudomembranous colitis, Disease-A-Month 2015 Mosby Inc. USA, vol. 61, No. 5, May 1, 2015, pp. 181-206, XP009193313, ISSN: 0011-5029 p. 195.
FDA Orphan Drug Designations. Total Orphan Drugs website. Aug. 2014. Available at http://www.orphan-drugs.org/2014/09/01/fda-orphandrug- designations-august-2014. Accessed on Apr. 13, 2016.
Federico E. Rey et al., "Dissecting the in Vivo Metabolic Potential of Two Human Gut Acetogens", The Journal of Biological Chemistry, vol. 285, No. 29, pp. 22082-22090, Jul. 16, 2010, EpubMay 5, 2010.
Fenner, et al., *Bacteroides massiliensis* sp. nov., isolated from blood culture of a newborn. International Journal of systematic and evolutionary microbiology, 2005. 55: 1335-1337.
Ferrario, C., Milani, C., Mancabelli, L., Lugli, G.A., Duranti, S., Mangifesta, M., et al. (2016). Modulation of the eps-ome transcription of bifidobacteria through simulation of human intestinal environment. FEMS Microbiol Ecol 92(4), fiw056. doi: 10.1093/femsec/fiw056. EpubMar. 8, 2016.
Flores-Langarica et al. (2012) "Systemic flagellin immunization stimulates mucosal CD1 03+ dendritic cells and drives Foxp3+ regulatory T Cell and IgA responses in the mesenteric lymph node," Journal of Immunology. 189 (12):5745-5754. Epub Nov. 14, 2012.
Fraley et al. (1986) "Genetic Transformation in Higher Plants," Critical Reviews Plant Science. 4:1-46.
Frame et al., Production of fertile transgenic maize plants by silicon carbide whisker-mediated transformation, The Plant Journal. 1994; 6:941-948.Dec. 1994.
Frank, D. et al., Molecular-phylogenetic characterization of microbial community imbalances in human inflammatory bowel diseases. 2007. PNAS. 104(34):13780-5.online Aug. 15, 2007.
Frick, et al., Identification of commensal bacterial strains that modulate Yersinia enterocolitica and Dextran sodium sulfate-induced inflammatory responses: implications for the development of probiotics. Infection and immunity, Jul. 2007;75(7):3490-3497. EpubMay 7, 2007.
Gaboriau-Routhiau et al. 'The key role of segmented filamentous bacteria in the coordinated maturation of gut helper T cell responses.' Immunity. 2009, vol. 31, No. 4, pp. 677-689.
Gait, M.J., (1984) Oligonucleotide Synthesis: A Practical Approach. Irl Press. pp. vii-xiii.
GB Exam and search report dated Aug. 30, 2016 for GB Application No. 1520638.6.
GB Search and Exam report dated Mar. 31, 2016 for GB application 1510469.8.
GB Search and Exam report dated Mar. 31, 2016 for GB application 1510470.6.
GB Search and Exam report dated Apr. 15, 2016 for GB application 1510467.2.
GB Search and Exam report dated Apr. 20, 2016 for GB application 1510466.4.
GB Search and Exam report dated Apr. 20, 2016 for GB application 1510468.0.
GB Search and Exam report dated Aug. 31, 2016 for GB application No. 1520631.1.
GB Search and Exam report dated Nov. 17, 2016 for GB application 1520502.4.
GB Search and Exam report dated Sep. 13, 2016 for GB application 1520497.7.
GB1612190.7 International Search Report dated Apr. 12, 2017.
GB1809729.5 Examination Report dated Oct. 15, 2018.
GenBank Accession No. ABI48297.1 (Jul. 20, 2007) "Fiat flagellin [Roseburia hominis]".
GenBank Accession No. ABY J02000000 (Nov. 8, 2013) Version 2. "Roseburia intestinal is L1-82, whole genome shotgun sequencing project".

(56) References Cited

OTHER PUBLICATIONS

GenBank Accession No.'s ABY J02000001—ABY J02000409 search results page (Last Updated Apr. 24, 2015).
GenBank accession No. AJ312385 (Oct. 9, 2002) "Roseburia intestinalis 16S rRNA gene, strain L 1-82".
GenBank Accession No. CP003040 (Aug. 5, 2011) Version 1. "Roseburia Hominis A2-183, complete genome".
GenBank Accession No. DQ789141. (Jul. 20, 2007) "Roseburia hominis Fla2 flagellin gene".
GenBank Accession No. M20983. (Apr. 26, 1993) "R.cecicola ftagellin gene".
GenBank Accession No. NR_044054.1 (Feb. 3, 2015) Blautia wexlerae strain SSM 19850 16S ribsomal RNA gene, partial sequence.
GenBank Accession No. NR_117867.1 (Feb. 3, 2015) Blautia stercoris strain GAM6-1 16S ribosomal RNA gene, partial sequence.
GenBank Accession No. KC456574.1 (May 3, 2013) Enterococcus casseliflavus strain ALK061 16S ribosomal RNA gene, partial sequence [Enterococcus casseliflavus], May 23, 2020:https://www.ncbi.nlm.nih.govinuccore/KC456574.1.
Genbank NCBI Reference Sequence: NR-044054.1, Blautia wexlerae strain DSM 19850 16S ribosomal RNA gene, partial sequence, accessed Feb. 5, 2019.
Genbank NCBI Reference Sequence: NR_117867.1, Blautia stercoris strain GAMC6-1 16S ribosomal RNA gene, partial sequence,accessed Feb. 5, 2019.
Genbank NCBI Reference Sequence: NR_026314, Blautia hydrongentrophica strain S5a36 16S ribosomal RNA gene, partial sequence, accessed Feb. 5, 2019.
Gennaro, A.R. Quality Assurance and Control. Remington: The Science and Practice of Pharmacy. 2000. Lippincott Williams & Wilkins, 20th ed. pp. 980-983.
Geraedts et al. 'Release of satiety hormones in response to specific dietary proteins is different between human and murine small intestinal mucosa.' Annals of Nutrition and Metabolism. 2010, vol. 56, No. 4, pp. 308-313. Epub Jun. 8, 2010.
Geuking et al. 'Intestinal bacterial colonization induces mutualistic regulatory T cell responses.' Immunity. 2011, vol. 34, No. 5, pp. 794-806. EpubMay 19, 2011.
Gewirtz et al. (2001) Cutting edge: bacterial flagellin activates basolaterally expressed TLR5 to induce epithelial proinflammatory gene expression. The Journal of Immunology. 167:(4)1882-1885.
Ghadimi, D. et al., Epigenetic imprinting by commensal probiotics inhibits the IL-23/IL-17 axis in an in vitro model of the intestinal mucosal immune system. JLB. 2012;92(4):895-911. Epub Jun. 22, 2012.
Giraud et al. 'Dissecting the genetic components of adaptation of *Escherichia coli* to the mouse gut.' PLoS Genetics.2008, vol. 4, No. 1, pp. e2.EpubNov. 27, 2007.
Goldin, B.R. et al., Clinical indications for probiotics: an overview. Clin Infect Dis. Feb. 1, 2008;46 Suppl 2:S96-100; discussion S144-51. doi: 10.1086/523333.
Gonzalez-Rodriguez, I., Sanchez, B., Ruiz, L., Turroni, F., Ventura, M., Ruas-Madiedo, P., et al. (2012). Role of extracellular transaldolase from Bifidobacterium bifidum in mucin adhesion and aggregation. Appl Environ Microbiol 78(11), 3992-3998. doi: 10.1128/AEM. 08024-11. Epub Mar. 23, 2012.
Gopal, P.K., Sullivan, P.A., Smart, J.B. Utilization of galacto-oligosaccharides as selective substrates for growth by lactic acid bacteria including Bifidobacterium lactis DR10 and Lactobacillus rhamnosus DR20 (200 1 ). International Dairy Journal, 11 (1-2), pp. 19-25. Dec. 31, 2000.
Gousia, P., et al., Antimicrobial resistance of major foodborne pathogens from major meat products (2011). Foodborne Pathogens and Disease, 8 (1), pp. 27-38. Epub Nov. 1, 2010.
Greenspan et al., Defining epitopes: Its not as easy as it seems. Nature Biotechnology 7: 936-937, 1999.Published:Oct. 1, 1999.
Groeger, D., O'Mahony, L., Murphy, E.F., Bourke, J.F., Dinan, T.G., Kiely, B., et al. (2013). Bifidobacterium infantis 35624 modulates host inflammatory processes beyond the gut. Gut Microbes 4(4), 325-339. doi: 10.4161/gmic.25487.
GT Biologics obtains FDA orphan drug designation for paediatric crohn's drug, pharmaceutical-technology.com news, Oct. 8, 2013. Available at: http://www.pharmaceutical-technology.com/news/newsgt-biologics-obtains-fda-orphan-drug-designation-for-paediatric-crohns-drug?Wt.mc_id=DN_News.
Haabeth et al. A model for cancer-suppressive inflammation. (2012) OncoImmunology 1(1):1146-1152.
Hammerich, L. et al., Interleukins in chronic liver disease: lessons learned from experimental mouse models. (2014) Clin Exp Gastroenterol. 7:297-306.Sep. 1, 2014.
Hansen, et al., The role of mucosal immunity and host genetics in defining intestinal commensal bacteria. 2010. Curr. Opin. Gastroenterol., 26(6): 564-571.
Hapfelmeier et al. 'Reversible microbial colonization of germ-free mice reveals the dynamics of IgA immune responses.' Science. 2010, vol. 328, No. 5986, pp. 1705-1709.
Hayashi et al. The innate immune response to bacterial flagellin is mediated by Toll-like receptor 5.' Nature. 2001, vol. 410, No. 6832, pp. 1099-1103.
Heberle, H., Meirelles, G.V., da Silva, F.R., Telles, G.P., and Minghim, R. (2015). InteractiVenn: a web-based tool for the analysis of sets through Venn diagrams. BMC Bioinformatics 16(1), 169. doi: 10.1186/s12859-015-0611-3.
Hedayat et al. (Mar. 1, 2012) "Prophylactic and therapeutic implications of toll-like receptor ligands," Medicinal Research Reviews. 32(2):294-325. Epub Oct. 25, 2010.
Heuvelin, E., Lebreton, C., Grangette, C., Pot, B., Cerf-Bensussan, N., and Heyman, M. (2009). Mechanisms Involved in Alleviation of Intestinal Inflammation by Bifidobacterium Breve Soluble Factors. Plos One 4(4), e5184. doi: 10.1371/journal.pone.0005184.EpubApr. 17, 2009.
Hidalgo-Cantabrana, C., Lopez, P., Gueimonde, M., de Los Reyes-Gavilan, C.G., Suarez, A., Margolles, A., et al. (2012). Immune Modulation Capability of Exopolysaccharides Synthesised by Lactic Acid Bacteria and Bifidobacteria. Probiotics Antimicrob Proteins 4(4), 227-237. doi: 10.1007/s12602-012-9110-2.
Hidalgo-Cantabrana, C., Sanchez, B., Alvarez-Martin, P., Lopez, P., Martinez-Alvarez, N., Delley, M., et al. (2015). A single mutation in the gene responsible for the mucoid phenotype of *Bifidobacterium animalis* subsp. lactis confers surface and functional characteristics. Appl Environ Microbiol 81(23), 7960-7968. doi: 10.1128/AEM.02095-15.online Oct. 30, 2015.
Hidalgo-Cantabrana, C., Sanchez, B., Milani, C., Ventura, M., Margolles, A., and Ruas-Madiedo, P. (2014). Genomic overview and biological functions of exopolysaccharide biosynthesis in *Bifidobacterium* spp. Appl Environ Microbiol 80(1), 9-18. doi: 10.1128/AEM.02977-13.EpubOct. 11, 2013.
Higgins, et al. CLUSTAL: A Package for Performing Multiple Sequence Alignment on a Microcomputer. Gene. 73 (1988): 237-244.
Hinchliffe (1993) "Yeast as a vehicle for the expression of heterologous genes," Yeasts. 2nd edition. Rose, A. R.; Harrison, J. H.: Eds. Academic Press Ltd. 5(9). pp. 325-356.
Hinnen et al., Transformation of yeast, Proc. Natl. Acad. Sci. USA. Apr. 1978; 75:1929-1933.
Hoarau, Cyrille et al., Supernatant from Bifidobacterium Differentially Modulates Transduction Signaling Pathways for Biological Functions of Human Dendritic Cells, Plos One, Public Library of Science, US, vol. 3, No. 7, Jul. 1, 2008 (Jul. 1, 2008), pp. e2753-1, XP009139666,ISSN: 1932-6203 *cf. abstract and conclusion, furthermore discussion part at p. 3, col. at the right side*.
Hoarau et al: "TLR2 Activation by Supernatant From Bifidobacterium Breve Modulates Maturation and Survival of Human DCs via Differential Effects on PI3Kinase, p38 and ERK Pathways", Journal of Allergy and Clinical Immuno, Elsevier, Amsterdam, NL, vol. 119, No. 1, Jan. 1, 2007 (Jan. 1, 2007), p. S258, XP005756921, ISSN: 0091-6749, DOI: 10.1016/J.JACI.2006.12.377 *cf. abs.No. 1008 at p. S258*.
Hoekema (1985) The Binary Plant Vector System Offset-drukkerij Kanters BB, Alblasserdam. Chapter V. pp. 63-71.

(56) References Cited

OTHER PUBLICATIONS

Hold et al. 'Oligonucleotide probes that detect quantitatively significant groups of butyrate-producing bacteria in human feces.' Applied and environmental microbiology. 2003, vol. 69, No. 7, pp. 4320-4324.
Holdeman, et al., *Eubacterium contortum* (Prevot) comb. nov.: Emendation of description and designation of the type strain. International journal of systematic bacteriology. Oct. 1971;21(4): 304-306.
Holland et al. (1990) "Secretion of Heterologous Proteins in *Escherichia coli*," Methods Enzymology. 182:132-143.
Hollenberg et al. (1997) "Production of recombinant proteins by methulotrophic yeasts," Current Opinion Biotechnology. 8(5):554-560.
Hooper at al. 'Molecular analysis of commensal host-microbial relationships in the intestine.' Science. 2001; vol. 291, No. 5505, pp. 881-884.
Horn, et al., Synthesis of Oligonucleotides on Cellulose. Part II: Design and Synthetic Strategy to the Synthesis of 22 Oligodeoxynucleotides Coding for Gastric Inhibitory Polypeptide (GIP). 1980. Nuc Acids Res Symp Ser 225-232.
Horwell, et al., The 'peptoid' approach to the design of non-peptide, small molecule agonists and antagonists of neuropeptides. 1995. Trends Biotechnol. 13(4):132-134.
Hossain et al. "Flagellin, a TLR5 agonist, reduces graft-versus-host disease in allogeneic hematopoietic stem cell transplantation recipients while enhancing antiviral immunity," Journal of Immunology. Nov. 2011; 187(10): p. 5130-5140.Nov. 15, 2011.
Hougee, et al., Oral treatment with probiotics reduces allergic symptoms in ovalbumin-sensitized mice:a bacterial strain comparative study. Int Arch Allergy Immunol. 2010; 151:107-117. Epub Sep. 15, 2009.
Hoyles L. et al. Gastrointestinal Tract, Chapter 56. Handbook of Hydrocarbon and Lipid Microbiology Springer Verlag Berlin 2010, 3120-32.
Hughes, K.R., Harnisch, L.C., Alcon-Giner, C., Mitra, S., Wright, C.J., Ketskemety, J., et al. (2017). Bifidobacterium breve reduces apoptotic epithelial cell shedding in an exopolysaccharide and MyD88-dependent manner. Open Biol 7(1). doi: 10.1098/rsob. 160155.
Hytönen, J., Haataja, S., and Finne, J. (2003). *Streptococcus pyogenes* Glycoprotein-Binding Strepadhesin Activity Is Mediated by a Surface-Associated Carbohydrate-Degrading Enzyme, Pullulanase. Infection and Immunity 71(2), 784-793.
Hytonen, J., Haataja, S., and Finne, J. (2006). Use of flow cytometry for the adhesion analysis of *Streptococcus pyogenes* mutant strains to epithelial cells: investigation of the possible role of surface pullulanase and cysteine protease, and the transcriptional regulator Rgg. BMC Microbiol 6, 18. doi: 10.1186/1471-2180-6-18. Publishedonline Feb. 24, 2006.
Ibrahim et al., "Method for the isolation of highly purified *Salmonella flagellins*," Journal of Clinical Microbiology. Dec. 1985; 22(6):1040-1044.
Inaba et al., "Generation of large numbers of dendritic cells from mouse bone marrow cultures supplemented with granulocyte/macrophage colony-stimulating factor," J. Exp. Med. Dec. 1992; 176(6):1693-1702.
International Preliminary Report dated Mar. 1, 2017 for International Application No. PCT/GB2015/054113.
International Preliminary Report on Patentability corresponding to International Patent Application No. PCT/GB2014/051123, dated Oct. 13, 2015.
International Preliminary Report on Patentability for International Application No. PCT/GB2012/051686 dated Jan. 14, 2014.
International Search Report dated Jan. 27, 2017 for International Application No. PCT/GB2016/053622.
International Search Report dated Feb. 10, 2016 for International Application No. PCT/GB2015/054113.
International Search Report dated Feb. 17, 2017 for International Application No. PCT/GB2016/053676.
International Search Report dated Mar. 7, 2016 for International Application No. PCT/GB2015/054112.
International Search report dated Mar. 15, 2003 for International Application No. PCT/GB2002/05255.
International Search Report dated Aug. 21, 2014 for International Application No. PCT/GB2014/051123.
International Search Report dated Aug. 26, 2016 for International application No. PCT/GB2016/051774.
International Search Report dated Aug. 26, 2016 for International application No. PCT/GB2016/051776.
International Search Report dated Sep. 6, 2016 for International application No. PCT/GB2016/051768.
International Search Report dated Sep. 6, 2016 for International application No. PCT/GB2016/051773.
International Search Report dated Sep. 6, 2016for International application No. PCT/GB2016/051770.
International Search Report dated Feb. 2, 2017 for International application No. PCT/GB2016/053620.
International Search Report dated Mar. 6, 2017 for International Application No. PCT/GB2016/053677.
International Search Report for International Application No. PCT/GB2012/051686 dated Jan. 31, 2013.
International Search Report for International Application No. PCT/GB2012/052495, dated Mar. 25, 2013.
International search report with written opinion dated Feb. 26, 2018 for PCT/GB2017/053722.
International search report with written opinion dated Jun. 8, 2017 for GB Application No. 1616016.
International search report with written opinion dated Sep. 29, 2017 for GB Application No. 1621123.
International search report with written opinion dated Oct. 16, 2017 for PCT/GB2017/052076.
Inturri, R., Molinaro, A., Di Lorenzo, F., Blandino, G., Tomasello, B., Hidalgo-Cantabrana, C., et al. (2017). Chemical and biological properties of the novel exopolysaccharide produced by a probiotic strain of *Bifidobacterium longum*. Carbohydr Polym 174, 1172-1180. doi: 10.1016/j.carbpol.2017.07.039. Epub Jul. 19, 2017.
Ishikawa, et al., Effect of bifidobacteria to suppress Th17, Food Science and technology institute, 2008, 5 Pages.
Ispirli, H. et al., Characterization of functional properties of Enterococcus faecium strains isolated from human gut.Can. J. Microbiol. 61: 861-870 (2015) dx.doi.org/10.1139/cjm-2015-0446.
Israel, E. et al., Supplementary Appendix, Severe and difficult-to-treat asthma in adults. N. Engl J Med 2017;p. 377:965-76. DOI: 10.1056/NEJMra1608969.
Israel, et al., Severe and difficult-to-treat asthma in adults, The New England Journal of Medicine, Sep. 2017; 377(10):965-976.
Issue Notification dated Feb. 20, 2019 for Co-Pending U.S. Appl. No. 15/631,945.
Ito et al. (1983) "Transformation of Intact Yeast Cells Treated with Alkali Cations," J. Bacteriology. 153:163-168.
Ivanov, D., Emonet, C., Foata, F., Affolter, M., Delley, M., Fisseha, M., et al. (2006). A serpin from the gut bacterium Bifidobacterium longum inhibits eukaryotic elastase-like serine proteases. J Biol Chem 281(25), 17246-17252. doi: 10.1074/jbc.M601678200. Epub Apr. 20, 2006.
Ivanov et al. 'Induction of intestinal Th17cells by segmented filamentous bacteria.' Cell. 2009, vol. 139, No. 3, pp. 485-498. available in PMCApr. 30, 2010.
Jackson MS, Bird AR, McOrist AL. Comparison of two selective media for the detection and enumeration of Lactobacilli in human faeces (2002). J Microbial Methods. 51 (3), pp. 313-321.
Jagveer Singh et al., "Bifidobacterium longum, a lactic acid-producing intestinal bacterium inhibits colon cancer and modulates the intermediate biomarkers of colon carcinogenesis", Carcinogenesis vol. 18 No. 4 pp. 833-841, Apr. 1997.
Jarchum et al., "Toll-Like Receptor 5 Stimulation Protects Mice from Acute Clostridium difficile Colitis," Infection and Immunity. Apr. 2011; 79(4):1498-1503.
Jawad, S. et al., Elevated serum levels of interleukin-17A in uveitis patients. Ocul Immunol Inflamm. Dec. 2013;21(6):434-9.doi: 10.3109/09273948.2013.815786. Epub Aug. 19, 2013.

(56) References Cited

OTHER PUBLICATIONS

Jenq, Robert R., Intestinal Bluatia is associated with reduced death from graft versus-host disease, Bio Blood Marro Transplant. Aug. 2015; 21(8): 1373-1383. doi:10.1016/j.bbmt.2015.04.016.
Jeon, S.G., Kayama, H., Ueda, Y., Takahashi, T., Asahara, T., Tsuji, H., et al. (2012). Probiotic Bifidobacterium breve induces IL-10-producing Tr1 cells in the colon. PLoS Pathog 8(5), e1002714. doi: 10.1371/journal.ppat.1002714. Epub May 31, 2012.
Jiao et al., Blockade of Notch Signaling Ameliorates Murine Collagen-Induced Arthritis via Suppressing Th1 and Th17 Cell Responses. 2014; Pathology, 184(4):1085-1093. Epub Feb. 1, 2014.
Joblin K N., "Ruminal Acetogens and Their Potential to Lower Remnant Methane Emissions." Australian Journal of Agricultural Research. vol. 50. No. 8. 1999, pp. 1307-1313. XP001010439.
Kailasapathy, K. Microencapsulation of Probiotic Bacteria:Technology and Potential Applications. Curr. Issues Intest. Microbiol. (2002) 3: 39-48.
Kanauchi, et al., Eubacterium limosum ameliorates experimental colitis and metabolite of microbe attenuates colonic inflammatory action with increase of mucosal integrity introduction, China World J Gastroenterol February, Jan. 1, 2006. pp. 1071-1077.
Kanauchi, et al., Eubacterium limosum (probiotic) and its metabolites showed anti-inflammatory effects and increased mucosal barrier function in colitis. Gastroenterology, 2005;128: p. A281, XP009193489.
Kang, S. et al. (2010) "Dysbiosis of fecal microbiota inCrohn's disease patients as revealed by a custom phylogenetic microarray," Inflammatory BowelDiseases. Dec. 2010;16(12):2034-2042.doi: 10.1002/ibd.21319.
Karaffova, et al., Interaction of TGF-B4 and IL-17 with IgA secretion in the intestine of chickens fed with E. faecium AL41 and challenged with S. Enteritidis. Research in Veterinary science. 2015:75-79. Epub Apr. 17, 2015.
Kari Shoaf et al., "Prebiotic Galactooligosaccharides Reduce Adherence of Enteropathogenic *Escherichia coli* to Tissue Culture Cells", Infection and Immunity, Dec. 2006, vol. 74. No. 12, p. 6920-6928 EpubSep. 18, 2006.
Karin, M. Nuclear factor-kappaB in cancer development and progression. Nature. May 25, 2006;441(7092):431-6.
Keller et al.. "DNA Probes", 1994. Stockton Press. New York. XP002158943 108660 pp. 594-596.
Kelly et al. 'Commensal anaerobic gut bacteria attenuate inflammation by regulating nuclear-cytoplasmic shuttling of PPAR-y and ReiA.' Nature Immunology. 2003, vol. 5, No. 1, pp. 104-112. Epub Dec. 21, 2003.
Kingsley M. A Personalized Approach to Managing 18D. Gastroenterology and Hepatology 12(5)308-315, May 2016.
Kinnebrew et al., Interleukin 23 production by intestinal CD1 03(+)CD11 b(+) dendritic cells in response to Interleukin 23 production by intestinal CD1 03(+ )CD11 b(+) dendritic cells in response to bacterial flagellin enhances mucosal innate immune defense, Immunity. 2012; 36(2): 276-287. EpubFeb. 2, 2012.
Kinoshita, H., Uchida, H., Kawai, Y., Kawasaki, T., Wakahara, N., Matsuo, H., et al. (2008). Cell surface Lactobacillus plantarum LA 318 glyceraldehyde-3-phosphate dehydrogenase (GAPDH) adheres to human colonic mucin. J Appl Microbiol 104(6), 1667-1674. doi: 10.1111/j.1365-2672.2007.03679.x.
Kirsty Minton: Mucosal immunology: The ins and outs of gut inflammation, The journal of immunology, 4(2), Feb. 1, 2004: pp. 81-81, XP055252701.
Kishimoto, M., Nomoto, R., Mizuno, M., and Osawa, R. (2017). An in vitro investigation of immunomodulatory properties of Lactobacillus plantarum and L. delbrueckii cells and their extracellular polysaccharides. Bioscience of Microbiota, Food and Health 36(3), 101-110. doi: 10.12938/bmfh.17-001.
Kitahara, M. et al., *Bacteroides plebeius* sp. nov. and *Bacteroides coprocola* sp. nov., isolated from human faeces, 2005; Int J Syst EvMicrobiol 55: 2143-47. FirstPublished: Sep. 1, 2005.

Klein, G."Taxonomy, Ecology and AntibioticResistance of Enterococci From Food and the Gastro-Intestinal Tract". Int.J. Food Microbiol. 2003, 88(2-3): 123-131; PMID: 14596985. Dec. 1, 2003.
Koenders, M.I. et al., Interleukin-17 Acts Independently of TNF-α under Arthritic Conditions. (2006) J. Immunol. 176:6262-6269.
Kogyo, S. Lactic Acid Bacteria, Intestinal Flora ad Health II; Physiological effects of heat-treated lactococcus "EF-2001" and application to food. Mar. 30, 2001, vol. 44, No. 6, pp. 35-39.
Koh, Gar Yee et al., Parabacteroides distasonis attenuate toll-like receptor 4 signaling and Akt activation and blocks colon tumor formulation in high-fat-diet-fed azoxymethane-treated mice, International Journal of Cancer,2018, 143, 1797-1805. Accepted Article, doi: 10.1002/ijc.31559,Apr. 26, 2018.
Korhonen, J.M., Sclivagnotis, Y., Von Wright, A Characterization of dominant cultivable lactobacilli and their antibiotic resistance profiles from faecal samples of weaning piglets (2007). Journal of Applied Microbiology, 103 (6), pp. 2496-2503.
Kumolosasi, E., Salim, E., Jantan, I., and Ahmad, W. (2014). Kinetics of Intracellular, Extracellular and Production of Pro-Inflammatory Cytokines in Lipopolysaccharide-Stimulated Human Peripheral Blood Mononuclear Cells. Tropical Journal of Pharmaceutical Research 13(4), 536-543. doi: 10.4314/tjpr.v13i4.8.
Kverka, M. et al., Oral administration of Parabacteroides distasonis antigens attenuates experimental murine colitis through modulation of immunity and microbiota composition. Clinical & Experimental Immunology. 2010; 163:250-259.
Laetitia Rodes et al., "Microencapsulated *Bifidobacterium longum* subsp. infantis ATCC 15697 Favorably Modulates Gut Microbiota and Reduces Circulating Endotoxins in F344 Rats", BioMed Research International, vol. 2014, Article ID 602832, 11 pages, . Epub May 22, 2014.
Lahteinen, T., et al., A Pro biotic propertiesof Lactobacillus isolates originating from porcine intestine and feces (2010) Anaerobe, 16 (3),pp. 293-300. Epub Aug. 18, 2009.
Lakhdari, et al. Identification of NF-KB Modulation Capabilities within Human Intestinal Commensal Bacteria. J Biomed Biotechnol. 2011; 2011: 282356.PublishedJun. 14, 2011.
Laukova, A. et al. Benefits of Combinative Application of Probiotic, Enterocin M-Producing Strain Enterococcus Faecium AL41 and Eleutherococcus Senticosus in Rabbits. Folia Microbiol (Praha) 61 (2), 169-177. Sep. 9, 2015.
Laukova A. et al. "Characteristics ofEnterococci and Staphylococci Isolated From the Crop and Caecum of Japanese QuailsExposed to Microgravity Conditions". Vet. Med. (Praha).Oct. 1995, 40(10): 317-321,PMID: 8659081.
Laukova A. "The Effect of Culture Media on Bacteriocin Production in Various Strains of Bacteria".Vet. Med. (Praha). 1992, 37(12): 661-666; PMID: 1297243.
Laureen Crouzet et al., "The altered gut microbiota of IBS patients plays a key role in visceral hypersensitivity: specific role of sulphate-reducing bacteria", INRA Symposium, 2012.
Lavallie et al. (1995) "Gene fusion expression systems in *Escherichia coli*," Current Opinion Biotechnology. 6 (5):501-506.
Law, J., Buist, G., Haandrikman, A., Kok, J., Venema, G., and Leenhouts, K. (1995). A system to generate chromosomal mutations in Lactococcus lactis which allows fast analysis of targeted genes. Journal of Bacteriology 177(24), 7011-7018.
Lebeer, S., Claes, I.J., Verhoeven, T.L., Vanderleyden, J., and De Keersmaecker, S.C. (2011). Exopolysaccharides of Lactobacillus rhamnosus GG form a protective shield against innate immune factors in the intestine. Microb Biotechnol 4(3), 368-374. doi: 10.1111/j.1751-7915.2010.00199.x. EpubAug. 17, 2010.
Lebeer, S., Verhoeven, T.L., Francius, G., Schoofs, G., Lambrichts, I., Dufrene, Y., et al. (2009). Identification of a Gene Cluster for the Biosynthesis of a Long, Galactose-Rich Exopolysaccharide in Lactobacillus rhamnosus GG and Functional Analysis of the Priming Glycosyltransferase. Appl Environ Microbiol 75(11), 3554-3563. doi: 10.1128/AEM.02919-08. Publishedonline Apr. 3, 2009.
Lee, et al. Intestinal microbiota in pathophysiology and management of irritable bowel syndrome . 2014. World J Gastroenterol. 20(27): 8886-8897.
Lejeune et al. Efficiency of Recombinant Human TNF in Human Cancer Therapy. Cancer Immun. 6:6 (2006).

(56) References Cited

OTHER PUBLICATIONS

Leser et al. 'Culture-independent analysis of gut bacteria: the pig gastrointestinal tract microbiota revisited'. Applied and Environmental Microbiology. 2002, vol. 68, No. 2, pp. 673-690.
Leslie, et al., Trehalose and sucrose protect both membranes and proteins in intact bacteria during drying. (1995) Appl. Environ. Microbiol. 61, 3592-3597.
Letran et al. 'TLR5-deficient mice lack basal inflammatory and metabolic defects but exhibit impaired CD4 T cell responses to a flagellated pathogen.' The Journal of Immunology. 2011, vol. 186, No. 9, pp. 5406-5412.Publishedonline Mar. 30, 2011.
Li, C.Y., Lin Hc Fau—Lai, C.-H., Lai Ch Fau—Lu, J.J.-Y., Lu Jj Fau—Wu, S.-F., Wu Sf Fau—Fang, S.-H., and Fang, S.H. (2011). Immunomodulatory effects of lactobacillus and Bifidobacterium on both murine and human mitogen-activated T cells. Int Arch Allergy Immunol 156(2), 128-136. doi: 10.1159/000322350.
Li et al, "Aluminum Hydroxide Adjuvants Activate Caspase-1 and Induce IL-113 andIL-18 Release" (2007) J Immunol, 178(8),5271-5276.
Li, et al,. Screening and Identification of Lactobacillus animalis strain and characteristics of its bacteriostatic protein, Weishengwuxue Tongbao 2009; 36(7): 1001-1007.
Li, Wei et al., "Structural changes of gut microbiota in Parkinson's disease and its correlation with clinical features", Science China Life Sciences, 2017, vol. 60, No. 11:1223-1233.
Lilley et al., Methods in Enzymology; DNA Structure Part A: Synthesis and Physical Analysis of DNA. 1992; vol. 2011. pp. v-vii.
Liu, Chang-jian et al., Antioxidant and Cholesterol-Reducing Properties of Enterococcus gallinarum m661, Bioengineering (Food Science), vol. 34, No. 7, Dec. 31, 2013, pp. 157-161.
Liu et al. Reclassification of *Clostridium coccoides, Ruminococcus hansenii, Ruminococcus hydrogenotrophicus, Ruminococcus luti, Ruminococcus productus* and *Ruminococcus schinkii* as *Blautia coccoides* gen. nov., comb. nov., *Blautia hansenii* comb. nov., *Blautia hydrogenotrophica* comb. nov., *Blautia luti* comb. nov., *Blautia producta* comb. nov., *Blautia schinkii* comb. nov. and description of *Blautia wexlerae* sp. nov., isolated from human faeces. 2008. Int J Syst Evol Microbiol 58,1896-1902.
Liu, Y., et al., Human-derived probiotic *Lactobacillus reuteri* strains differentially reduce intestinal inflannuation (20 10). American Journal of Physiology—Gastrointestinal and Liver Physiology, 299 (5), pp. G1087-G1096.
Ljungh, A, Wadstrorn, T. Lactic acid bacteria as probiotics (2006). Current Issues in Intestinal Microbiology, 7 (2), pp. 73-90.
Lodemann, U. et al., Effects of the Probiotic enterococcus faecium and pathogenic *Escherichia coli* strains in a pig and human epithelial intestinal cell model. Hindawi publishing corporation scientifica. 2015(235184) 10 pages. Epub Mar. 26, 2015.
Lopetuso et al. Commensal Clostridia: leading players in the maintenance of gut homeostasis. 2013. Gut Pathogens, 5: 23.
Lopez, P., Gonzalez-Rodriguez, I., Sanchez, B., Ruas-Madiedo, P., Suarez, A., Margolles, A., et al. (2012). Interaction of Bifidobacterium bifidum LMG13195 with HT29 cells influences regulatory-T-cell-associated chemokine receptor expression. Appl Environ Microbiol 78(8), 2850-2857. doi: 10.1128/AEM.07581-11.Epub Feb. 17, 2012.
Lopez-Boado, Y. S. et al., Bacterial Exposure Induces and Activates Matrilysin in Mucosal Epithelial Cells. J Cell Biol148, 1305-1315 (2000).
Louis et al. 'Diversity, metabolism and microbial ecology of butyrate-producing bacteria from the human large Intestine.' FEMS Microbiology Letters. 2009, vol. 294, No. 1, pp. 1-8. EpubFeb. 13, 2009.
Louis et al. 'Diversity of human colonic butyrate-producing bacteria revealed by analysis of the butyryl—GoA: acetate GoA—transferase gene.' Environmental Microbiology. 2010, vol. 12, No. 2, pp. 304-314. EpubOct. 5, 2009.
Louis et al. 'Organization of butyrate synthetic genes in human colonic bacteria: phylogenetic conservation and horizontal gene transfer.' FEMS Microbiology Letters. 2007, vol. 269, No. 2, pp. 240-247.Published:Apr. 1, 2007.

Lozupone. Diversity, stability and resilience of the human gut microbiota. 2012. Nature. Sep. 13, 2012; 489 (7415): 220-230.
López, P., González-Rodríguez, I., Gueimonde, M., Margolles, A., and Suárez, A. (2011). Immune Response to Bifidobacterium bifidum Strains Support Treg/Th17 Plasticity. Plos One 6(9), e24776. doi: 10.1371/journal.pone.0024776.
López, P., Gueimonde, M., Margolles, A., and Suárez, A. (2010). Distinct *Bifidobacterium* strains drive different immune responses in vitro. International Journal of Food Microbiology 138(1), 157-165. doi: https://doi.org/10.1016/j.ijfoodmicro.2009.12.023.
Luger, D. and Caspi, R.R., New perspectives on effector mechanisms in uveitis. (2008) Semin. Immunopathol. 30(2): 135-143. Published online Mar. 4, 2008.
Álvarez-Martin, P., O'Connell-Motherway, M., van Sinderen, D., and Mayo, B. (2007). Functional analysis of the pBC1 replicon from Bifidobacterium catenulatum L48. Applied Microbiology and Biotechnology 76(6), 1395. doi: 10.1007/s00253-007-1115-5.
Lyons, et al., Bacterial strain-specific induction of Foxp3 T regulatory cells is protective in murine allergy models. Clinical & Experimental Allergy. 2010; 40:811-819. EpubJan. 11, 2010.
Machiels, et al., Predominant dysbiosis in patients with ulcerative colitis is different from Crohn's disease patients, Inflammatory Bowel Diseases, Microbiology 2012. 8th Congress of ECCO. (This Abstract Is in 7th Congress 2012).
Machiels, K., A decrease of the butyrate-producing species Roseburia hominis and Faecalibacterium prausnitzii defines dysbiosis in patients with ulcerative colitis. Gut. Aug. 2014;63(8):1275-83. doi: 10.1136/gutjnl-2013-304833. Epub Sep. 10, 2013.
MacPherson, AJ. et al., IgA responses in the intestinal mucosa against pathogenic and non-pathogenic microorganisms. Oct. 2001. 3(12). 1021-1035.
MacPherson, AJ., et al., The functions of mucosal T cells in containing the indigenous commensal flora of the intestine.Cell Mol Life Sci. Dec. 2002;59(12):2088-96.
MacPherson et al. 'IgA adaptation to the presence of commensal bacteria in the intestine.' Gut-Associated Lymphoid Tissues. Springer Berlin Heidelberg, 2006. 117-136.
MacSharry et al., Immunomodulatory effects of feeding with bifidobacterium longum on allergen-induced lung inflammation in the mouse. Pulmonary pharmacology & Therapeutics. 2012; 25:325-334. EpubJun. 13, 2012.
Mahowald et al. 'Characterizing a model human gut microbiota composed of members of its two dominant bacterial phyla.' Proceedings of the National Academy of Sciences. 2009, vol. 106, No. 14, pp. 5859-5864. EpubMar. 24, 2009.
Maintaining Cultures for Biotechnology and Industry (1996) Jennie C. Hunter-Cevera, Academic Press.
Mallya et al. 'Characterization of the five novel Ly—6 superfamily members encoded in the MHC, and detection of cells expressing their potential ligands.' Protein Science. 2006, vol. 15, No. 10, pp. 2244-2256. Oct. 2006.
Manni et al., A tale of two cytokines: IL-17 and IL-22 in asthma and infection. Expert Rev Respir Med. Feb. 2014; 8(1): 25-42. doi:10. 1586/17476348.2014.854167.Publishedonline Dec. 10, 2013.
Mansour et al. Isolation of Enterococcus faecium NM113, Enterococcus faecium NM213 and Lactobacillus casei NM512 as novel probiotics with immunomodulatory properties. (2014) Microbiol Immunol. 58(10):559-69.
Martin et al., Cloning, Nucleotide Sequence, and Taxonomic Implications of the Flagellin Gene of Roseburia cecicola, Journal of Bacteriology. Jun. 1988; 170(6):2612-2617.
Martin R. et al., Isolation of lactobacilli from sow milk and evaluation of their probiotic potential. J of dairy research 76(4)418-425. Nov. 2009. EpubJul. 29, 2009.
Masco, L., et al., Identification of *Bifidobacterium* Species Using rep-PCR Fingerprinting. Systematic and Applied Microbiology 26(4):557-63 • Nov. 2003.
Matsuda F et al: Evaluation of a probiotics,BBG-01, for enhancement of immunogenicity of an oral inactivated cholera vaccine and safety: A randomized, double-blind, placebo-controlled trial in

(56) References Cited

OTHER PUBLICATIONS

Bangladeshi children under 5 years of age, Vaccine, Elsevier, Amsterdam, NL, vol. 29, No. 10, Dec. 26, 2010 (Dec. 26, 2010), pp. 1855-1858, XP028147184, ISSN: 0264-410X, DOI: 10.1016/J.VACCINE.2010.12.133 [retrieved on Jan. 7, 2011] *cf. abstract*.

Matthes, et al., Simultaneous rapid chemical synthesis of over one hundred oligonucleotides on a microscale. Apr. 1984. EMBO Journal, 3(4): p. 801-805.

Maya, J.R. et al., Emerging Therapies for Noninfectious Uveitis: What May Be Coming to the Clinics. (2014) J. Ophthalmology. 310329,EpubApr. 24, 2014.

Mazmanian et al. 'An immunomodulatory molecule of symbiotic bacteria directs maturation of the host immune system.' Cell. 2005, vol. 122, No. 1, pp. 107-118.

McCarville, J.L., Dong, J., Caminero, A., Bermudez-Brito, M., Jury, J., Murray, J.A., et al. (2017). A Commensal Bifidobacterium longum Strain Prevents Gluten-Related Immunopathology in Mice through Expression of a Serine Protease Inhibitor. Applied and Environmental Microbiology 83(19), e01323-01317. doi: 10.1128/AEM.01323-17. PrintOct. 1, 2017.

McClymont, S.A., Putnam Al Fau—Lee, M.R., Lee Mr Fau—Esensten, J.H., Esensten Jh Fau—Liu, W., Liu W Fau—Hulme, M.A., Hulme Ma Fau—Hoffmuller, U., et al. (2011). Plasticity of human regulatory T cells in healthy subjects and patients with type 1 diabetes. Journal of Immunology 186(7), 3918-3926. doi: 10.4049/jimmunol.1003099.

McIntosh et al. 'Mechanism of conjugated linoleic acid and vaccenic acid formation in human faecal suspensions and pure cultures of intestinal bacteria.' Microbiology. 2009, vol. 155, No. 1, pp. 285-294.

McLaughlin et al. Fatty acid chainlength determines cholecystokinin secretion and effect on human gastricmotility. Gastroenterology. 1999, vol. 116, No. 1, pp. 46-53.

Menard, S., Laharie D Fau—Asensio, C., Asensio C Fau—Vidal-Martinez, T., Vidal-Martinez T Fau—Candalh, C., Candalh C Fau—Rullier, A., Rullier A Fau—Zerbib, F., et al. (2005). Bifidobacterium breve and *Streptococcus thermophilus* secretion products enhance T helper 1 immune response and intestinal barrier in mice. Experimental Biology and Medicine (Maywood) 230(10), 749-756.

Meyer et al. (1992) "The use of cassava mosaic virus as a vector system for plants," Gene. 110:213-217.

Meyza, et al. The BTBR mouse model of idiopathic autism—Current view on mechanisms. 2017. Neurosci Biobehav Rev.;76(Pt A):99-110, EpubFeb. 3, 2017.

Mikayama, et al., Molecular cloning and functional expression of a cDNA encoding glycosylation-inhibiting factor. Proc. Nati. Acad. Sci. USA, Nov. 1993; vol. 90: 10056-10060.

Milani, C., Mangifesta, M., Mancabelli, L., Lugli, G.A., Mancino, W., Viappiani, A., et al. (2017). The Sortase-Dependent Fimbriome of the Genus Bifidobacterium: Extracellular Structures with Potential to Modulate Microbe-Host Dialogue. Appl Environ Microbiol 83(19). doi: 10.1128/AEM.01295-17.

Mincheol Kim et al., "Towards a taxonomic coherence between average nucleotide identity and 16S rRNA gene sequence similarity for species demarcation of prokaryotes", International Journal of Systematic and Evolutionary Microbiology (2014), 64, 346-351, Feb. 1, 2014.

Miossec et al., Targeting IL-17 and TH17 cells in chronic inflammation, 2012; Nature Drug Discovery 11, 763-776.

Miossec, P. et al. Targeting IL-17 and TH17 cells in chronic inflammation. Nat Rev Drug Discov. Oct. 2012;11(10):763-76. doi: 10.1038/nrd3794.

Miraglia Del Giudice, M., Indolfi, C., Capasso, M., Maiello, N., Decimo, F., and Ciprandi, G. (2017). Bifidobacterium mixture (B longum BB536, B infantis M-63, B breve M-16V) treatment in children with seasonal allergic rhinitis and intermittent asthma. Italian Journal of Pediatrics 43(1), 25. doi: 10.1186/513052-017-0340-5.

Mitropoulou, G. et al. Immobilization Technologies in Probiotic Food Production. (2013) Journal Nutr Metab. (2013) 716861.

Miyake, T. et al., Phylogenetic Analysis of the Genus *Bifidobacterium* and Related Genera Based on 16S rDNA Sequences. Microbiol. Immunol. 1998; 42(10):661-667.

Miyamoto-Shinohara et al. Survival of freeze-dried bacteria. J Gen Appl Microbiol 54(1):9-24 (2008).

Miyauchi, E., Control of multiple sclerosis by gut microbiota. Journal of clinical and experimental medicine. 2015. vol. 253 No. 5.2, pp. 445-450.

Molecular Biology Techniques, 1st edition. An intensive laboratory course. 1998.

Monteleone et al., IL-10-dependent partial refractoriness to Toll-like receptor stimulation modulates gut mucosal dendritic cell function, European Journal of Immunology. 2008; 38(6):1533-1547.

Monteleone, I. et al., Th17-related cytokines: new players in the control of chronic intestinal inflammation. (2011) BMC Medicine. 2011, 9:122.

Morel S, et al. "Adjuvant System AS03 containing α-tocopherol modulates innate immune response and leads to improved adaptive immunity", Vaccine. Mar. 16, 2011;29(13):2461-73. doi: 10.1016/j.vaccine.2011.01.011. Epub Jan. 20, 2011. PMID:21256188.

Mortaz, E. et, al., Anti-Inflammatory Effects of Lactobacillus Rahmosus and Bifidobacterium Breve on Cigarette Smoke Activated Human Mcrophiages, PLoS ONE, Apr. 21, 2015, 10(8):e0136455.DOI:10.1371, Journal.pone.0136455, Publishedonline Aug. 28, 2015.

Mucientes, A. et al., Specific association of IL17A genetic variants with panuveitis. (2015) Br J Ophthalmol. 99(4):566-70. EpubJan. 16, 2015.

Mukai et al., SH3BP2 Gain-Of-Function Mutation Exacerbates Inflammation and Bone Loss in a Murine Collagen-Induced Arthritis Model, 2014 PLoS ONE 9(8): e105518. Aug. 21, 2014.

Mulder et al. 'Environmentally-acquired bacteria influence microbial diversity and natural innate immune responses at gut surfaces'. BMC Biology. 2009, vol. 7, No. 1, pp. 79, Published:Nov. 20, 2009.

Murofushi, Y., Villena, J., Morie, K., Kanmani, P., Tohno, M., Shimazu, T., et al. (2015). The toll-like receptor family protein RP105/MD1 complex is involved in the immunoregulatory effect of exopolysaccharides from Lactobacillus plantarum N14. Mol Immunol 64(1), 63-75. doi: 10.1016/j.molimm.2014.10.027. EpubNov. 13, 2014.

Narushima, et al., Characterization of the 17 strains of regulatory T cell-inducing human derived Clostridia. Gut Microbes Mar. 18, 2014; 5:3, 333-339.

Naughton PJ; Grant G. (2005) Modelling of salmonellosis in: Microbial Ecology of the Growing Animal Holzapfel WH, Naughton PJ. (Eds). London, Elsevier. pp. 235-257.

NCBI Reference Sequence: NR_026314.1, Blautia hydrogenotrophica strain S5a36 16S ribosomal RNA gene, partial sequence (Feb. 3, 2015), 3 pages.

Neeser, J.R., et al., Lactobacillus johnsoniiLa1 shares carbohydrate-binding specificities with several enteropathogenicbacteria (2000). Glycobiology, 10 (11), pp. 1193-1199.

Neish, A. S. et al., Prokaryotic Regulation of Epithelial Responses by Inhibition of IκB-α Ubiquitination. Science 289, 1560 (2000).

Neish et al., TLRS in the Gut. II. Flagellin-induced inflammation and antiapoptosis, American Journal of Physiology—Gastrointestinal and Liver Physiology. 2007;292:G462-466.

Nemeth et al. 'Inhibition of *Salmonella*-induced IL-8 synthesis and expression of Hsp70 in enterocyte-like Caco-2 cells after exposure to non-starter lactobacilli'. International Journal of Food Microbiology. 2006, vol. 112, No. 3, pp. 266-274, EpubOct. 12, 2006.

Neville, B.A., Functional genomics of motile commensal intestinal bacteria. PhD Thesis. University College Cork. 2013. 281 Pages.

Neville, et al., Characterization of pro-inflammatory flagellin proteins produced by Lactobacillus ruminis and related motile Lactobacilli. PloS one. Jul. 2012;7(7):e40592. Publishedonline Jul. 10, 2012.

Neyrinck et al. 'Dietary modulation of clostridial cluster XIVa gut bacteria (*Roseburia* spp.) by chitin-glucan fiber improves host metabolic alterations induced by high-fat diet in mice.' The Journal of Nutritional Biochemistry. 2012, vol. 23, No. 1, pp. 51-59. EpubMar. 15, 2011.

(56) References Cited

OTHER PUBLICATIONS

Ng et al., Archaeal flagella, bacterial flagella and type IV pili: a comparison of genes and posttranslation modification, Journal of Molecular Microbiology and Biotechnology. 2006;11:167-191.
Nicolau, D.P. Current challenges in the management of the infected patient (2011). Current Opinion in Infectious Diseases, 24 (Suppll), pp. SI-S10.
Non-Final Office Action dated Oct. 8, 2019 for U.S. Appl. No. 16/265,238.
Non-Final Office Action dated Oct. 9, 2019 for U.S. Appl. No. 15/969,543.
Notice of Allowance dated Feb. 3, 2016 for U.S. Appl. No. 14/349,907.
Notice of Allowance dated Mar. 6, 2017 for U.S. Appl. No. 14/249,710.
Notice of Allowance dated Mar. 30, 2011 for U.S. Appl. No. 10/285,224.
Notice of Allowance dated Apr. 25, 2016 for U.S. Appl. No. 14/232,475.
Notice of allowance dated Jun. 16, 2017 for U.S. Appl. No. 14/249,710.
Notice of Allowance dated Aug. 23, 2016 for U.S. Appl. No. 14/232,475.
Notice of allowance dated Sep. 1, 2017 for U.S. Appl. No. 15/357,850.
Notice of allowance dated Sep. 6, 2017 for U.S. Appl. No. 14/249,710.
Notice of Allowance dated Nov. 17, 2016 for U.S. Appl. No. 14/249,710.
Notice of Allowance dated Nov. 22, 2017 for U.S. Appl. No. 15/359,988.
Notice of Allowance dated Nov. 24, 2017 for U.S. Appl. No. 15/070,605.
Notice of Publication dated Dec. 27, 2018 for U.S. Appl. No. 16/022,256.
Nuala Moran: 'Microbial wealth', chemistry and industry, 78(6), Jun. 1, 2014, pp. 20-23, XP055252922.
Numasaki, M. et al., IL-17 Enhances the Net Angiogenic Activity and In Vivo Growth of Human Non-Small Cell Lung Cancer in SCID Mice through Promoting CXCR-2-Dependent Angiogenesis. (2005) J. Immunol. 175: 6177-6189. Nov. 1, 2005.
Numasaki, M. et al., Interleukin-17 promotes angiogenesis and tumor growth. Blood. Apr. 1, 2003;101(7):2620-7. Epub Oct. 31, 2002.
Nutsch et al., T cell tolerance and immunity to commensal bacteria. Current Opinion in Immunology. Aug. 2012; 24 (4):385-391. EpubMay 19, 2012.
O'Connell Motherway, M., Kinsella, M., Fitzgerald, G.F., and Sinderen, D. (2013). Transcriptional and functional characterization of genetic elements involved in galacto oligosaccharide utilization by Bifidobacterium breve UCC2003. Microbial biotechnology 6(1), 67-79. doi: 10.1111/1751-7915.12011. EpubDec. 2, 2012.
O'Connell Motherway, M., O'Driscoll, J., Fitzgerald Gerald, F., and Van Sinderen, D. (2009). Overcoming the restriction barrier to plasmid transformation and targeted mutagenesis in Bifidobacterium breve UCC2003. Microbial Biotechnology 2(3), 321-332. doi: 10.1111/j.1751-7915.2008.00071.x., Publishedonline Apr. 17, 2009.
O'Connell Motherway, M., Zomer, A., Leahy, S.C., Reunanen, J., Bottacini, F., Claesson, M.J., et al. (2011). Functional genome analysis of Bifidobacterium breve UCC2003 reveals type IVb tight adherence (Tad) pili as an essential and conserved host-colonization factor. Proc Natl Acad Sci USA 108(27), 11217-11222. doi: 10.1073/pnas.1105380108., EpubJun. 20, 2011.
Odamaki, Toshitaka et al., "Age-related changes in gut microbiota composition from newborn to centenarian: a cross-sectional study," BMC Microbiology (2016) 16:90, pp. 1-12, DOI 10.1186/S12866-016-0708-5., Published:May 25, 2016.
Odile Menard et al, "Gnotobiotic Mouse Immune Response Induced by *Bifidobacterium* sp. Strains Isolated from Infants", Applied and Environmental Microbiology, Feb. 2008, p. 660-666, EpubDec. 14, 2007.
Office Action dated Jan. 2, 2018 for U.S. Appl. No. 15/357,936.

Office Action dated Jan. 11, 2005 for U.S. Appl. No. 10/285,224.
Office Action dated Jan. 26, 2009 for U.S. Appl. No. 10/275,706.
Office Action dated Feb. 18, 2010 for U.S. Appl. No. 10/285,224.
Office Action dated Mar. 13, 2013 for U.S. Appl. No. 12/760,926.
Office Action dated Mar. 26, 2007 for U.S. Appl. No. 10/275,706.
Office Action dated Apr. 4, 2008 for U.S. Appl. No. 10/285,224.
Office Action dated May 2, 2007 for U.S. Appl. No. 10/285,224.
Office Action dated May 2, 2008 for U.S. Appl. No. 10/275,706.
Office Action dated May 25, 2016 for U.S. Appl. No. 14/249,710.
Office Action dated May 26, 2009 for U.S. Appl. No. 10/285,224.
Office Action dated May 26, 2017 for U.S. Appl. No. 15/357,850.
Office Action dated May 30, 2006 for U.S. Appl. No. 10/285,224.
Office Action dated Jun. 26, 2017 for U.S. Appl. No. 15/357,936.
Office Action dated Jul. 6, 2017 for U.S. Appl. No. 15/070,605.
Office action dated Jul. 8, 2015 for U.S. Appl. No. 14/349,907.
Office Action dated Jul. 31, 2017 for U.S. Appl. No. 15/359,988.
Office Action dated Aug. 10, 2017 for U.S. Appl. No. 15/357,850.
Office Action dated Aug. 21, 2013 for U.S. Appl. No. 12/760,926.
Office Action dated Sep. 4, 2015 for U.S. Appl. No. 14/249,710.
Office Action dated Sep. 17, 2010 for U.S. Appl. No. 10/285,224.
Office Action dated Oct. 12, 2005 for U.S. Appl. No. 10/285,224.
Office Action dated Oct. 28, 2009 for U.S. Appl. No. 10/275,706.
Office Action dated Oct. 30, 2008 for U.S. Appl. No. 10/285,224.
Office Action dated Nov. 2, 2017 for U.S. Appl. No. 15/700,007.
Office Action dated Nov. 6, 2006 for U.S. Appl. No. 10/285,224.
Office Action dated Nov. 23, 2015 for U.S. Appl. No. 14/232,475.
Office Action dated Nov. 24, 2017 for U.S. Appl. No. 15/359,972.
Office Action dated Nov. 24, 2017 for U.S. Appl. No. 15/679,857.
Office Action dated Dec. 6, 2017 for U.S. Appl. No. 15/592,178.
Office Action dated Dec. 13, 2012 for U.S. Appl. No. 12/760,926.
Office Action dated Dec. 19, 2005 for U.S. Appl. No. 10/275,706.
Office Action dated Mar. 19, 2019 for U.S. Appl. No. 16/031,024.
Ohashi, Y., Ushida, K. Health-beneficial effects of probiotics: Its mode of action (2009). Animal Science Journal, 80 (4), pp. 361-371.
Oladipo, et al., Bioprotective potential of bacteriocinogenic enterococcus gallinarum strains isolated from some Nigerian fermented foods, and of their bacteriocins. Polish Journal of Microbiology. 2014; 63(4): 415-422.
Olivares, M., Castillejo, G., Varea, V., and Sanz, Y. (2014). Double-blind, randomised, placebo-controlled intervention trial to evaluate the effects of Bifidobacterium longum CECT 7347 in children with newly diagnosed coeliac disease. British Journal of Nutrition 112(1), 30-40. doi: 10.1017/S0007114514000609.
Olivera et al. 'Nutritional and physiological responses of young growing rats to diets containing raw cowpea seed meal, protein isolate (globulins), or starch.' Journal of agricultural and food chemistry. 2003, vol. 51, No. 1, pp. 319-325., PublicationDate: Dec. 3, 2002.
O'Sullivan et al., "Bacterial Supplementation in the Irritable Bowel Syndrome. A Randomised Double-Blind Placebo-Controlled Crossover Study", Digest Liver Dis. 2000. pp. 294-301.
Overbeek, R., Begley, T., Butler, R.M., Choudhuri, J.V., Chuang, H.-Y., Cohoon, M., et al. (2005). The Subsystems Approach to Genome Annotation and its Use in the Project to Annotate 1000 Genomes. Nucleic Acids Research 33(17), 5691-5702. doi: 10.1093/nar/gki866.
Overstreet et al. 'Dysbiosis Characterized by Reduced Abundance of Roseburia is Associated With Increased Severity of Colitis in IL-10-/- Mice'. Gastroenterology. 2011, vol. 140, No. 5, Suppl. 1, pp. S-696.
Pace et al. Macrophage activation : Priming activity from a T-cell hybridoma is attributable to interferon. (1983) PNAS. 80:3782-6.
Pang, et al., Crystal structure of human pirin: an iron-binding nuclear protein and transcription cofactor. Journal of Biological Chemistry, 279(2); Jan. 9, 2004:1491-1498., EpubOct. 22, 2003.
Parabacteroides distasonis (Eggerth and Gagnon) Sakamoto and Benno (ATCC 8503). Sep. 19, 2017. 2 Pages.
Parfenov A.I., "Pain syndrome inthe practice of a gastroenterologist", RMJ Breast Cancer, 2008; 0: 32.Jan. 25, 2008 https://www.rmjsu/articles/bolevoy_sindrom/Bolevoy_sindrom_v_praktike_gastroenterologa-.

(56) References Cited

OTHER PUBLICATIONS

Park, S.K. et al., *Blautia stercoris* sp. nov., isolated from human faeces. International journal of systematic and evolutionary microbiology. 2012; 62(4): 776-779., EpubMay 13, 2011.
Patel., R. et al., Determination of 16S rRNA sequences of enterococci and application to species identification of nonmotile enterococcus gallinarum isolates. Journal of clinical microbiology, 1998; 36(11):3399-3407.
Paustian, C., Taylor, P., Johnson, T., Xu, M., Ramirez, N., Rosenthal, K.S., et al. (2013). Extracellular ATP and Toll-like receptor 2 agonists trigger in human monocytes an activation program that favors T helper 17. PLoS One 8(1), e54804. doi: 10.1371/journal.pone.0054804., EpubJan. 31, 2013.
PCR (Introduction to Biotechniques Series), 2nd ed. (Newton & Graham eds., 1997, Springer Verlag).
PCT/EP2017/025038 International Preliminary Report on Patentability dated Jun. 6, 2018, 8 Pages.
PCT/EP2017/025038 International Search Report and Written Report dated Jun. 12, 2017.
PCT/EP2017/025038 Written Opinion of the International Preliminary Examining Authority dated Jan. 1, 2018.
PCT/EP2017/025038 Written Opinion of the International Preliminary Examining Authority dated Jan. 25, 2018.
PCT/GB2017/052076 Written Opinion of the International Preliminary Examining Authority dated Jun. 21, 2018, 11 Pages.
PCT/GB2017/052077 International Search Report dated Oct. 16, 2017.
PCT/GB2017/052077 Written Opinion dated Oct. 16, 2017.
PCT/GB2017/052077 Written Opinion of the International Preliminary Examining Authority dated Jun. 21, 2018, 10 Pages.
Pearson, WR. An introduction to sequence similarity ("Homology") searching. Current protocols in bioinformatics/editorial board. Chapter 3: Unit 3.1 (2013).
Pedro Berraondo et al., "Cytokines in clinical cancer immunotherapy", British Journal of Cancer, 2019, 120:6-15, EpubNov. 9, 2018.
Petersen et al. Intestinal colonization with phylogenetic group B2 *Escherichia coli* related to inflammatory bowel disease: a systematic review and meta-analysis. 2015. Scand J Gastroenterol.; 50(10):1199-207., EpubApr. 24, 2015.
Peterson et al. 'Catecholamines increase conjugative gene transfer between enteric bacteria.' Microbial Pathogensis. 2011, vol. 51, No. 1, pp. 1-8., EpubMar. 22, 2011.
Petsuriyawong et al. 'Screening of probiotic lactic acid bacteria from piglet feces'. Nature Science. 2011, vol. 45, pp. 245-253.
Ping Dong et al., "The role of intestinal bifidobacteria on immune system development in young rats", Early Human Development 86 (2010) 51-58, EpubJan. 27, 2010.
Pinto-Sánchez, M.I., Smecuol, E.C., Temprano, M.P., Sugai, E., González, A., Moreno, M.L., et al. (2017). Bifidobacterium infantis NLS Super Strain Reduces the Expression of α-Defensin-5, a Marker of Innate Immunity, in the Mucosa of Active Celiac Disease Patients. Journal of Clinical Gastroenterology 51(9), 814-817. doi: 10.1097/mcg.0000000000000687.
Polak J.M. and McGee J.O., In Situ Hybridization: Principles and Practice, Oxford University Press. 1990; pp. vii-viii.
Potrykus (1991) "Gene Transfer to Plants: Assessment of Published Approaches and Results," Annu. Rev. Plant Physiol. Plant Mol. Bioi. 42:205-225.
Prakash, et al., Complete genome sequences of rat and mouse segmented filamentous bacteria, a potent inducer of th17 cell differentiation. Cell Host & Microbe. Sep. 2011 ;10(3):273-284.
Pryde et al. 'The microbiology of butyrate formation in the human colon.' FEMS Microbiology Letters. 2002. vol. 217,No. 2, pp. 133-139.
Punt et al. (2002) "Filamentous fungi as cell factories for heterologous protein production," Trends Biotechnol. 20 (5):200-206.
Qin et al. 'A human gut microbial gene catalogue established by metagenomic sequencing.' Nature. 2010, vol. 464, No. 7285, pp. 59-65.

Rajilic-Stojanovic, et al. The first 1000 cultures species of the human gastrointestinal microbiota . FEMS Mlcriobiol Rev, vol. 38, 2014. pp. 996-1047.
Reddy, K.B.P.K., et al., Role of cryoprotectants on the viability and functional properties of pro biotic lactic acid bacteria during freeze drying (2009). Food Biotechnology, 23 (3), pp. 243-265., Publishedonline: Aug. 3, 2009.
Reiff,C. and Kelly,D.,Inflammatory bowel disease, gut bacteria and probiotic therapy. International journal of medical microbiology, 2010;300:25-33., EpubOct. 2, 2009.
Reuter, G. (2001). The Lactobacillus and Bifidobacterium microflora of the human intestine: composition and succession. Current Issues in Intestinal Microbiology 2(2), 43-53.
Rhee et al.,Toll-Like Receptor 5 Engagement Modulates Tumor Development and Growth in a Mouse Xenograft Model of Human Colon Cancer. Gastroenterology. Aug. 2008;135(2):518-528, EpubApr. 23, 2008.
Rhee, Young-Kyung et al., Antitumor Activity of *Bifidobacterium* Spp. isolated from a healthy Korean, Arch Pharm Res vol. 23, No. t, 482-487 2000. Oct. 2000.
Riquelme. Will 4D Pharma be UK's next Microbiome leader? Feb. 2, 2015, LABIOTECH.eu [online].
Robertson, J.M.C., et al., Lack of flagella disadvantages *Salmonella enterica* serovar Enteritidis during the early stages of infection in the rat (2003). Journal of Medical Microbiology, 52 (1), pp. 91-99.
Robinson, et al. Inside information—The unique features of visceral sensation. 2008. Mol Interv, 8(5): 242-253.
Rockwell, S.C. et al., Characteristics of a Serially Transplanted Mouse Mammary Tumor and Its Tissue-Culture-Adapted Derivative. (1972) J Natl Cancer Inst. 49:735-49.
Roe, et al., DNA Isolation and Sequencing: Essential Techniques. John Wiley & Sons, New York, New York. 1996; pp. v-vii.
Rong, Y., Dong, Z., Hong, Z., Jin, Y., Zhang, W., Zhang, B., et al. (2017). Reactivity toward Bifidobacterium longum and Enterococcus hirae demonstrate robust CD8(+) T cell response and better prognosis in HBV-related hepatocellular carcinoma. Experimental Cell Research 358(2), 352-359. doi: 10.1016/j.yexcr.2017.07.009, EpubJul. 8, 2017.
Roseburia. Ubiome, 2018. Accessed on Jun. 25, 2018; Available at: https://shop.ubiome.com/pages/roseburia-1.
Round et al. 'The Toll-like receptor 2 pathway establishes colonization by a commensal of the human microbiota.' Science. 2011, vol. 332, No. 6032, pp. 974-977, EpubApr. 21, 2011.
Rudinger J, "Characteristics of the amino acids as components of a peptide hormone sequence," Peptide Hormones, JA Parsons Edition, University Park Press, Jun. 1976, pp. 1-7.
Ruiz, L., Delgado, S., Ruas-Madiedo, P., Margolles, A., and Sanchez, B. (2016). Proteinaceous Molecules Mediating Bifidobacterium-Host Interactions. Front Microbiol 7, 1193. doi: 10.3389/fmicb.2016.01193, Publishedonline Aug. 3, 2016.
Ruiz, P.A., Hoffmann, M., Szcesny, S., Blaut, M., and Haller, D. (2005). Innate mechanisms for Bifidobacterium lactis to activate transient pro-inflammatory host responses in intestinal epithelial cells after the colonization of germ-free rats. Immunology 115(4), 441-450. doi: 10.1111/j.1365-2567.2005.02176.x.
Russell et al. 'High-protein, reduced-carbohydrate weight-loss diets promote metabolite profiles likely to be detrimental to colonic health.' The American Journal of Clinical Nutrition. 2011, vol. 93, No. 5, pp. 1062-1072.
Sagar, et al., Bifidobacterium breve and lactobacillus rhamnosus treatment is as effective as budesonide at reducing inflammation in a murine model for chronic asthma. Respiratory Research. 2014; 15(46):1-17.Published:Apr. 16, 2014.
Saiki, et al., Primer-directed enzymatic amplification of DNA with a thermostable DNA polymerase. 1988. Science, 239. pp. 487-491. Jan. 29, 1988.
Sakamato, et al., *Parabacteroides faecis* sp. nov., isolated from human faeces. International Journal of Systematic and Evolutionary Microbiology (2015), 65, 1342-1346.EpubFeb. 9, 2015.
Sakamoto, et al., *Parabacteroides gordonii* sp. nov., isolated from human blood cultures. International Journal of Systematic and Evolutionary Microbiology (2009), 59, 2843-2847.EpubJul. 23, 2009.

(56) References Cited

OTHER PUBLICATIONS

Sakamoto, et al., *Parabacteroides johnsonii* sp. nov., isolated from human faeces. International Journal of Systematic and Evolutionary Microbiology (2007), 57, 293-296.
Sakamoto Mitsuo et al., Reclassfication of Baceroides distasonis, Bacteroides goldsteinii and Bacteroides merdae as *Parabacteroides distasonis* gen. nov., comb. nov., *Parabacteroides goldsteinii* comb. nov. and *Parabacteroides merdae* comb. nov., International Journal of Systematic and Evolutionary Microbiology (2006) 56, 15-99-1605. DOI 10.1099/ijs.0.0641920.
Salix Pharmaceuticals, Inc. FDA Highlights of Prescribing Information—XIFAXAN (rifaximin tablet). Revised Nov. 2015.
Salminen et al. 'Probiotics: how should they be defined?.' Trends in Food Science & Technology. 1999, vol. 10, No. 3, pp. 107-110.
Salonen et al., Gastrointestinal microbia in irritable bowel syndrome: present state and perspectives. Microbiology. 2010; 156: 3205-3215.EpubAug. 12, 2010.
Scanlan PD., et al., Culture-independent analyses of temporal variation of the dominant fecal microbiota and targeted bacterial subgroups in Crohn's disease. J Clin Microbiol. Nov. 2006;44(11):3980-8. Epub Sep. 20, 2006.
Scher et al., Expansion of intestinal Prevotella copri correlates with enhanced susceptibility to arthritis. 2013; eLIFE 2, e01202, 20 Pages.
Schiavi, E., Gleinser, M., Molloy, E., Groeger, D., Frei, R., Ferstl, R., et al. (2016). The Surface-Associated Exopolysaccharide of Bifidobacterium longum 35624 Plays an Essential Role in Dampening Host Proinflammatory Responses and Repressing Local TH17 Responses. Appl Environ Microbiol 82(24), 7185-7196. doi: 10.1128/AEM.02238-16.
Schiavi, E., Plattner, S., Rodriguez-Perez, N., Barcik, W., Frei, R., Ferstl, R., et al. (2018). Exopolysaccharide from *Bifidobacterium longum* subsp. longum 35624 modulates murine allergic airway responses. Benef Microbes, 1-14. doi: 10.3920/BM2017.0180. EpubMay 4, 2018.
Schieck, M. et al., Genetic variation in TH17 pathway genes, childhood asthma, and total serum IgE levels.(2014) J Allergy Clin Immunol. 133(3):888-91. EpubNov. 1, 2013.
Schleifer, K.H. et al., Transfer of *Streptococcus faecalis* and *Streptococcus faecium* to the Genus *Enterococcus* nom. rev. as *Enterococcus faecalis* comb. nov. and *Enterococcus faecium* comb. nov. Int J Syst Evol Microbiol, Jan. 1984 34: 31-34, doi:10.1099/00207713-34-1-31.Jan. 1, 1984.
Schmitz, S. et al., A prospective, randomized, blinded, placebo-controlled pilot study on the effect of Enterococcus faecium on clinical activity and intestinal gene expression in canine food-responsive chronic enteropathy. J Vet Intern Med. Mar.-Apr. 2015;29(2):533-43. doi: 10.1111/jvim.12563. Epub Mar. 16, 2015.
Schouten, et al., Cow milk allergy symptoms are reduced in mice fed dietary synbiotics during oral sensitization with whey. J Nutr. Nutritional Immunology. Jul. 2009; 139(7):1398-403. Epub May 27, 2009.
Schreiber, O, et al., Lactobacillus reuteri prevents colitis by reducing P-selectin-associated leukocyte- and plateletendothelial cell interactions (2009). American Journal of Physiology Gastrointestinal and Liver Physiology, 296 (3), pp. G534-G542.
Schulke et al. (Aug. 26, 2011) "A fusionprotein of flagellin and ovalbumin suppresses the 25 TH2 response and preventsmurine intestinal allergy," The Journal of Allergy and Clinical Immunology. 128(6):1340-1348.
Schwiertz, et al., Quantification of Different *Eubacterium* spp. in Human Fecal Samples with Species-Specific 16S rRNA-Targeted Oligonucleotide Probes. Applied and environmental biology, vol. 66, No. 1, Jan. 1, 2000; pp. 375-382.
Scott et al. 'Substrate-driven gene expression in Roseburia inulinivorans: importance of inducible enzymes in the utilization of inulin and starch.' Proceedings of the National Academy of Sciences. 2011, vol. 108, Supp. 1, pp. 672-4679.

Scuotto, Angelo et al., In silico mining and characterization of bifidobacterial lipoprotein with CHHP domain secreted in an aggregated form, International J. of Biol. Macromolecutes 82(2016), 653-662.
Sczesnak, et al., The genome of th17 cell-inducing segmented filamentous bacteria reveals extensive auxotrophy and adaptations to the intestinal environment. Cell Host Microbe. Sep. 2011;10 (3):260-272.
Severijnen, A. J. et al., Chronic Arthritis Induced in Rats by Cell Wall Fragments of *Eubacterium* Species from the Human Intestinal Flora. Infection and Immunity, 1990, vol. 58, No. 2, 523-528.
Sgadari, C. et al., Interferon-inducible protein-10 identified as a mediator of tumor necrosis in vivo. (1996) PNAS. 93:13791-6.
Sgadari et al. Mig, the Monokine Induced by Interferon-g, Promotes Tumor Necrosis In Vivo. (1997) Blood. 89:2635-43.Nov. 26, 1996.
Shabgah, A.G. et al., Interleukin-17 in human inflammatory diseases. Postepy Dermatol Alergol. Aug, 2014; 31(4): 256-261. EpubSep. 8, 2014.
Shevach et al., Current Protocols in Immunology. John Wiley & Sons. New York, New York. 1992. Table of Contents only, as accessed online at URL: http://www.4ulr.com/products/currentprotocols/immunology_toc.html. [Last Accessed Jun. 18, 2015].
Simon, et al., Peptoids: A modular approach to drug discover, Oct. 1992. PNAS, 89(20):9367-9371.
Simpson-Herren, L. et al., Kinetic parameters and growth curves for experimental tumor systems. Cancer Chemother Rep. Jun. 1970;54(3):143-74.
Sisson, G. et al., Randomised clinical trial: a liquid multi-strain probiotic vs. placebo in the irritable bowel syndrome—a 12 week double-blind study. Aliment Pharmacol Ther. 2014; 40: 51-62. EpubMay 11, 2014.
Sivan, A., Corrales, L., Hubert, N., Williams, J.B., Aquino-Michaels, K., Earley, Z.M., et al. (2015). Commensal Bifidobacterium promotes antitumor immunity and facilitates anti-PD-L1 efficacy. Science 350(6264), 1084-1089. doi: 10.1126/science.aac4255.
Sivieri, K. et al., Probiotic enterococcus faecium CRL 183 inhibit chemically induced colon cancer in male wistar rats. Eur Food Res Technol. 2008; 228:231-237.
Skolnick, et al. From genes to protein structure and function: novel applications of computational approaches in the genomic era. Trends Biotechnol. Jan. 2000;18(1):34-9. Review.
Skountzou, et al., *Salmonella flagellins* are potent adjuvants for intranasally administered whole inactivated influenza vaccine. Vaccine. May 2010; 28(24):4103-4112.
Smith, C.L., et al., Lactobacillus fermentumBRII and fructooligosaccharide partially reduce jejunal inflammation in amodel of intestinal mucositis in rats (2008). Nutrition and Cancer, 60 (6), pp. 757-767.
Smith et al. Comparison of Biosequences. Advances in Applied Mathematics. 2:482-489 (1981).
Sokol et al. 'Faecalibacterium prausnitzii is ananti-inflammatory commensal bacterium identified by gut microbiota analysis ofCrohn disease patients.' Proceedings of the National Academy of Sciences. 2008,vol. 105, No. 43, pp. 6731-16736. Epub Oct. 20, 2008.
Sokol et al. 'Low counts of Faecalibacterium prausnitzii in colitis microbiota.' Inflammatory bowel diseases. 2009, vol. 15, No. 8, pp. 1183-1189.Feb. 23, 2009.
Song et al., Impact of Schistosoma japonicum Infection on Collagen-Induced Arthritis in DBA/1 Mice: A Murine Model of Human Rheumatoid Arthritis. 2011; PLoS ONE 6, e23453, 10 pages. EpubAug. 8, 2011.
Song, Yuli et al., *Bacteroides goldsteinii* sp. nov. Isolated from Clinical Specimens of Human Intestinal Origin, J. Clinical Microbiology, Sep. 2005, p. 4522-4527. DOI:10.1128/JCM.43.9.4522-4527.2005.
Sonnenburg, et al., Genomic and Metabolic Studies of the Impact of Probiotics on a Model Gut Symbiont and Host. PLoS Biol, 2006,4(12): e413. https://doi.org/10.1371/journal.pbio.0040413.,Publishedonline Nov. 28, 2006.
Spor, A. et al., Unravelling the effects of the environment and host genotype on the gut microbiome. Nat Rev Microbiol. Apr. 2011;9(4):279-90. doi: 10.1038/nrmicro2540.

(56) References Cited

OTHER PUBLICATIONS

Srutkova, D. et al., Efficiency of PCR-based methods in discriminating *Bifidobacterium longum* ssp. longum and *Bifidobacterium longum* ssp. infantis strains of human origin.J Microbiol Methods. Oct. 2011;87(1):10-6. doi: 10.1016/j.mimet.2011.06.014. Epub Jul. 2, 2011.

Stanton et al. (1983) "*Roseburia cecicola* gen. nov., sp. nov., a Motile, Obligately Anaerobic Bacterium from a Mouse Cecum," Int. J. Syst. Bacterial. 33:618-627.

Stokholm, et al., Maturation of the gut microbiome and risk of asthma in childhood. Nature Communications, 2018; 9(141): 1-10.

Stoll et al., Altered microbiota associated with abnormal humoral immune responses to commensal organisms in enthesitis-related arthritis, 2014; Arthritis Res Ther. 16:486.

Strasser, S. et al., Influence of lyophilization, fluidized bed drying, addition of protectants, and storage on the viability oflactic acid bacteria (2009). Journal of Applied Microbiology, 107 (1), pp. 167-177.EpubMar. 3, 2009.

Strickertsson, J.A. et al., Enterococcus faecalis Infection and Reactive Oxygen Species Down-Regulates the miR-17-92 Cluster in Gastric Adenocarcinoma Cell Culture. Genes 2014, 5(3), 726-738.

Strobel, H.J. Basic laboratory culture methods for anaerobic bacteria. Methods Mol Biol. 2009;581:247-61. doi: 10.1007/978-1-60761-214-8_16.

Strus et al. Distinct effects of Lactobacillus plantarum KL30B and *Escherichia coli* 3A1 on the induction and development of acute and chronic inflammation. 2015. Cent Eur J Immunol.40(4):420-30. EpubJan. 15, 2016.

Sudha B. Singh and Henry C. Lin, "Hydrogen Sulfide in Physiology and Diseases of the Digestive Tract", Microorganisms 2015, 3, 866-889; doi:10.3390/microorganisms3040866, Nov. 12, 2015.

Sun, D. et al., The role of Th17-associated cytokines in the pathogenesis of experimental autoimmune uveitis (EAU). (2015) Cytokine. 74(1):76-80.EpubMar. 2, 2015.

Sun, et al., Exploring gut microbes in human health and disease: Pushing the envelope. Genes Dis. Dec. 2014; 1(2):132-139.doi:10.1016/j.gendis.2014.08.001. Published online Aug. 10, 2014.

Supplement to: Israel, et al., Severe and difficult-to-treat asthma in adults. N Engl J Med 2017; 377:965-76.

Suzanne L. Topalian et al., "Survival, Durable Tumor Remission, and Long-Term Safety in Patients With Advanced Melanoma Receiving Nivolumab", Journal of Clinical Oncology, vol. 32, No. 10, Apr. 1, 2014, pp. 1-12, EpubMar. 3, 2014.

Tahoun, A., Masutani, H., Ei-Sharkawy, H., Gillespie, T., Honda, R.P., Kuwata, K., et al. (2017). Capsular polysaccharide inhibits adhesion of Bifidobacterium longum 105-A to enterocyte-like Caco-2 cells and phagocytosis by macrophages. Gut Pathog 9, 27. doi: 10.1186/s13099-017-0177-x.

Takashi Nakamura et al., "Evaluation of the Effects of Dietary Organic Germanium, Ge-132, and Raffinose Supplementation on Caecal Flora in Rats", Bioscience of Microbiota, Food and Health vol. 31 (2), 37-45, 2012, EpubApr. 20, 2012.

Tamanai-Shacoori, et al., *Roseburia* spp.: a marker of health?. Future Microbiology Review 12(2), 157-170 (2017).Feb. 2017.

Tan, Hai-Qin et al., *Parabacteroides chartae* sp. nov., an obligately anaerobic species from wastewater of a paper mill, International Journal of systematic and Evolutionary Microbiology (2012), 62-2613-2617, DOI 10.1099/ijs.0.038000-0.

Tanaka, K. and Watanabe, K., In Vitro tebipenem activity against anaerobic bacteria. Japanese Journal of Chemotherapy. Mar. 2009. vol. 57 S-1.

Tap et al. Towards the human intestinal microbiota phylogenetic core. 2009. Environ Microbiol, 11(10):2574-84.EpubJul. 6, 2009.

Tatusova, et al., Erratum to BLAST 2 Sequences, a new tool for comparing protein and nucleotide sequences [FEMS Microbiol. 174 (1999) 247-250], FEMS Microbial. Lett. 1999;177(1):187-188.

Tatusova et al., BLAST 2 Sequences, a new tool for comparing protein and nucleotidesequences, FEMS Microbiology Letters 174 (1999) 247-250.

Teng, L. J. et al., PCR Assay for Species-SpecificIdentification of Bacteroides thetaiotaomicron. JClin Microbiol38, 1672-1675 (2000).

Terciz, Janos et al., Inflammation and Colon Cancer, Gastroenterology, 2010: 138: 2101-2114.

Tesmer, LA. et al., Th17 cells in human disease. Immunol Rev. 2008;223:87-113.

Tilg, et al., Roseburia hominis: a novel guilty player in ulcerative colitis pathogenesis? Gut, Oct. 14, 2013;63(8)1204-1205.EpubOct. 14, 2013.

Tomas, M.S.J., et al., Stability of freeze-dried vaginal *Lactobacillus* strains in the presence of different lyoprotectors (2009). Canadian Journal of Microbiology, 55 (5), pp. 544-552.

Tomosada, Y., Villena, J., Murata, K., Chiba, E., Shimazu, T., Aso, H., et al. (2013). Immunoregulatory Effect of *Bifidobacteria* Strains in Porcine Intestinal Epithelial Cells through Modulation of Ubiquitin-Editing Enzyme A20 Expression. Plos One 8(3), e59259. doi: 10.1371/journal.pone.0059259.EpubMar. 26, 2013.

Toomer, O. et al., Maternal and postnatal dietary probiotic supplementation enhances splenic regulatory T helper cell population and reduces peanut allergen-induced hypersensitivity responses in mice. Immunobiology. 209; 2014: 661-670.EpubMay 14, 2014.

Travis, et al. Complete genome sequence of the human gut symbiont Roseburia hominis. Genome announcements. 2015; 3(6):e01286-15.Publishedonline Nov. 5, 2015.

Tremaroli, et al., A role for the gut microbiota in energy harvesting? Gut. Dec. 2010; 59(12):1589-1590.

Trueman (1995) "Heterologous Expression in Yeast," Methods Molecular Biology. 49:341-354.

Tsukinowa, et al., Fecal microbiota of a dugong (Dugong dugong) in captivity at Toba Aquarium. J. Gen. Appl. Microbiol., 54, 25-38 (2008).

Turnbaugh et al. A core gut microbiome in obese and lean twins. Jan. 22, 2009. Nature, 457(7228): 480-484.

Turnbaugh, et al., An obesity-associated gut microbiome with increased capacity for energy harvest. Nature. Dec. 2006;444(7122):1027-1031.

Turnbaugh et al., Diet-induced obesity is linked to marked but reversible alterations in the mouse distal gut microbiome. Cell Host & Microbe. Apr. 2008;3(4):213-223.

Turner (1994) "Vectors for genetic manipulation," In; Martinelli, S.D.; Kinghorn J. R.: Eds. Aspergillus: 50 years on. Progress in industrial microbiology. vol. 29. Elsevier. Amsterdam, The Netherlands. pp. 641-666.

Turroni, F., Taverniti V Fau—Ruas-Madiedo, P., Ruas-Madiedo P Fau—Duranti, S., Duranti S Fau—Guglielmetti, S., Guglielmetti S Fau—Lugli, G.A., Lugli Ga Fau—Gioiosa, L., et al. (2014). Bifidobacterium bifidum PRL2010 modulates the host innate immune response. Appl Environ Microbiol 80(1098-5336 (Electronic)), 730-740.

Tzortzis, G., et al., Modulation of anti-pathogenic activity in canine-derived *Lactobacillus* species by carbohydrate growth substrate (2004). Journal of Applied Microbiology, 96 (3), pp. 552-559.

Udayappan, et al., Oral treatment with Eubacterium hallii improves insulin sensitivity in db/db mice. NPJ Biofilms and microbiomes, vol. 2, Jul. 6, 2016; p. 16009.

Udayappan et al., PS4-5. Administration of Eubacterium hallii improves insulin sensitivity and degree of liversteatosis in male db/db mice. Nederlands tijdschrift voor diabetologie, vol. 11, No. 4., Nov. 23, 2013.pp. 145.

Ukena, et al., Probiotic *Escherichia coli* Nissle 1917 inhibits leaky gut by enhancing mucosal integrity, PloS one. Dec. 2007;2(12):e1308.

Untergasser, A., Nijveen, H., Rao, X., Bisseling, T., Geurts, R., and Leunissen, J.A. (2007). Primer3Plus, an enhanced web interface to Primer3. Nucleic Acids Res 35(Web Server issue), W71-74. doi: 10.1093/nar/gkm306.EpubMay 7, 2007.

U.S. Appl. No. 15/357,936 Notice of Allowance dated Apr. 18, 2018.

U.S. Appl. No. 15/359,144 Notice of Allowance dated Sep. 4, 2018.

U.S. Appl. No. 15/359,972 Notice of Allowance dated Aug. 8, 2018.

U.S. Appl. No. 15/359,988 Notice of Allowance dated Mar. 2, 2018.

U.S. Appl. No. 15/359,988 Notice of Allowance dated Mar. 16, 2018.

(56) References Cited

OTHER PUBLICATIONS

U.S. Appl. No. 15/592,178 Notice of Allowance dated Apr. 12, 2018.
U.S. Appl. No. 15/592,178 Notice of Allowance dated Jul. 12, 2018.
U.S. Appl. No. 15/631,945 Notice of Allowance dated Oct. 18, 2018.
U.S. Appl. No. 15/700,007 Notice of Allowance dated Oct. 17, 2018.
U.S. Appl. No. 15/915,885 Notice of Allowance dated May 23, 2018.
U.S. Appl. No. 15/915,889 Notice of Allowance dated Jun. 4, 2018.
U.S. Appl. No. 15/916,167 Notice of Allowance dated May 31, 2018.
U.S. Appl. No. 15/916,202 Notice of Allowance dated Jun. 11, 2018.
U.S. Appl. No. 15/916,205 Notice of Allowance dated May 30, 2018.
U.S. Appl. No. 15/359,144 Office Action dated Apr. 10, 2018.
U.S. Appl. No. 15/359,972 Office Action dated Apr. 4, 2018.
U.S. Appl. No. 15/431,393 Office Action dated Jul. 30, 2018.
U.S. Appl. No. 15/631,945 Office Action dated Jul. 5, 2018.
U.S. Appl. No. 15/631,945 Office Action dated May 15, 2018.
U.S. Appl. No. 15/631,952 Office Action dated Feb. 16, 2018.
U.S. Appl. No. 15/631,952 Office Action dated Jul. 19, 2018.
U.S. Appl. No. 15/673,270 Office Action dated Apr. 10, 2018.
U.S. Appl. No. 15/679,857 Office Action dated Aug. 6, 2018.
U.S. Appl. No. 15/679,857 Office Action dated Feb. 14, 2018.
U.S. Appl. No. 15/700,007 Non-Final Office Action dated Jun. 10, 2019.
U.S. Appl. No. 15/700,007 Office Action dated Jun. 1, 2018.
U.S. Appl. No. 15/704,245 Non-Final Office Action dated Jul. 3, 2019.
U.S. Appl. No. 15/704,245 Office Action dated Sep. 17, 2018.
U.S. Appl. No. 15/803,723 Notice of Allowance dated Feb. 13, 2018.
U.S. Appl. No. 15/842,635 Office Action dated Aug. 27, 2018.
U.S. Appl. No. 15/842,635 Non-Final Office Action dated May 29, 2019.
U.S. Appl. No. 16/022,577 Non-Final Office Action dated Jul. 9, 2019.
Van De Bogert, et al., Immunomodulatory properties of *Streptococcus* and veillonella isolates from the human small intestine microbiota, PLOS One, Dec. 2014: 1-20, DOI:10.1371/journal.pone.0114277.
Van de Pot, M.A. et al., Synbiotics reduce allergen-induced T-helper 2 respond and improve peak expiatory flow in allergic asthmatics, Allergy 2011;66:39-47. Epub Aug. 17, 2010.
Van De Veerdonk, et al., The Anti-CD20 antibody rituximab reduces the Th17 cell response. Arthritis & Rheumatism. Jun. 2011; 63(6):1507-1516.
Van Immerseel et al. 'Butyric acid-producing anaerobic bacteria as a novel probiotic treatment approach for inflammatory bowel disease.' Journal of medical microbiology. 2010, vol. 59, No. 2, pp. 141-143.
Van Nevel et al., "Control of RumenMethanogenesis." Environmental Monitoring and Assessment. vol. 42, 1996,pp. 73097, XP000979267.
Van Tilburg, M. Can we treat visceral hypersensitivity in functional abdominal pain? Lancet Gastroenterolhepatol, 2017; 2 Pages.
Verheijden, K.A.T. et al., The development of allergic inflammation in a murine house dust mite asthma is suppressed by symbiotic mixtures of non-digestible oligosaccharides and Bifidobacterium breve M-16V; Eur. J. Nut. (2016) 55: 1141-1151, DOI 10.1007, 500394-015-0928-8.
Vetrovsky, T. and Baldrian, P., The variability of the 16S rRNA gene in bacterial genomes and its consequences for bacterial community analyses. Plos One. Feb. 2013; 8(2): e57923.

Viaud, Sophie et al. "The intestinal microbiota modulates the anticancer immune effects of cyclophosphamide." Science (New York, N.Y.) vol. 342,6161 (2013): 971-6. doi:10.1126/science.1240537.
Vijay-Kumar, et al., Deletion of TLR5 results in 10 spontaneous colitis in mice. The Journal of Clinical Investigation. Dec. 2007;117(12):3909-3921.
Vijay-Kumar et al., Flagellin Treatment Protects against Chemicals, Bacteria, Viruses, and Radiation. The Journal of Immunology. 2008;180(12):8280-8285.
Walker et al. 'Dominant and diet-responsive groups of bacteria within the human colonic microbiota.' The ISME Journal. 2010, vol. 5, No. 2, pp. 220-230.EpubAug. 5, 2010.
Wang, Chun-Sai-Er, et al., VSL#3 can prevent ulcerative colitis-associated carcinogenesis in mice, Oct. 7, 2018, vol. 24, Issue 37, pp. 4254-4262.
Wang et al. 16S rRNA gene-based analysis of fecal microbiota from preterm infants with and without necrotizing enterocolitis. 2009. ISME J. 3(8): 944-954.EpubApr. 16, 2009.
Wang, Feng, Bifidobacterium can mitigate intestinal immunopathology in the context of CTLA-4 blockade, PNA, Jan. 2, 2018 vol. 115, No. 1, pp. 157-161.EpubDec. 18, 2017.
Wang, G., Xia, Y., Cui, J., Gu, Z., Song, Y., Q., C.Y., et al. (2014). The Roles of Moonlighting Proteins in Bacteria. Current Issues in Molecular Biology 16, 15-22.EpubJul. 22, 2013.
Wang, R.F., and Kushner, S.R. (1991). Construction of versatile low-copy-numbers vectors for cloning, sequencing and gene expression in *Escherichia coli*. Gene 100, 195-199. doi: https://doi.org/10.1016/0378-1119(91)90366-J.
Wang W., Lyophilization and development of solid protein pharmaceuticals. International J. Pharmaceutics 203: 1-60, 2000.
Watson, et al., Signal transduction in Campylobacter jejuni-induced cytokine production. Cellular Microbiology. 2005;7(5):655-665.
Wei, X., Yan, X., Chen, X., Yang, Z., Li, H., Zou, D., et al. (2014). Proteomic analysis of the interaction of Bifidobacterium longum NCC2705 with the intestine cells Caco-2 and identification of plasminogen receptors. J Proteomics 108, 89-98. doi: 10.1016/j.jprot.2014.04.038.
Weigel, et al., Comparative analysis of murine marrow-derived dendritic cells generated by Flt3L or GMCSF/IL-4 and matured with immune stimulatory agents on the in vivo induction of antileukemia responses. Blood. Dec. 1, 2002;100(12):4169-4176. Epub Aug. 8, 2002.
Welman, A.D., and Maddox, I.S. (2003). Exopolysaccharides from lactic acid bacteria: perspectives and challenges. Trends in Biotechnology 21(6), 269-274. doi: https://doi.org/10.1016/S0167-7799(03)00107-0.
Wendler, et al., Identification of a pirin, a novel highly conserved nuclear protein. J. Biol Chem. Mar. 28, 1997; 272(13):8482-9.
Wenzel, S.E., Asthma phenotypes: the evolution from clinical to molecular approaches, Nature medicine, May 2012; 18(5):716-725.
Werth, et al., The transcription factor grainyhead-like 2 regulates the molecular composition of the epithelial apical junctional complex. Development. 2010;37(22):3835-3845.
Westermann, C., Gleinser, M., Corr, S.C., and Riedel, C.U. (2016). A Critical Evaluation of Bifidobacterial Adhesion to the Host Tissue. Front Microbiol 7, 1220. doi: 10.3389/fmicb.2016.01220. Aug. 5, 2016.
Williams, N.T. Probiotics (2010). American Journal of Health-System Pharmacy, 67 (6), pp. 449-458.Mar. 15, 2010.
Wilson, et al., The TLR5 ligand flagellin promotes asthma by priming allergic responses to indoor allergens. Nature Medicine. Nov. 2012;18(11):1705-1710.
Workman et al. Guidelines for the welfare and use of animals in cancer research (2010) Br. J. Cancer. 102:1555-77.
Written Opinion for PCT/US17/066709 dated Jun. 4, 2018 (Published as WO2018112363) owned by Evelo Biosciences, Inc.
Written Opinion for PCT/US2017/066713 dated Aug. 13, 2018 (Published as WO2018/112365) owned by Evelo Biosciences, Inc.
Wrzosek, et al., Bacteroides thetaiotaomicron and Faecalibacterium prausnitzii influence the production of mucus glycans and the

(56) References Cited

OTHER PUBLICATIONS development of globlet cells in the colonic epithelium of a gnotobiotic model rodent. BMC biology, 2013;11(61):1-13.Published:May 21, 2013.

Wunderlich, P.F. et al., Double-blind report on the efficacy of lactic acid-producing enterococcus SF68 in the prevention of antibiotic-associated diarrhoea and in the treatment of acute diarrhoea. The journal of international medical research. 1989; 17: 333-338.

Xie et al. Short communication: Modulation of the small intestinal microbial community composition over short-term or long-term administration with Lactobacillus plantarum ZDY2013. 2016. Journal Dairy Sci. 99:6913-6921.EpubJun. 16, 2016.

Xu, et al., A genomic view of the human-Bacteroides thetaiotaomicron symbiosis. Science. Mar. 28, 2003; 299(5615):2074-6.

Xu, et al., Differential development of murine dendritic cells by GM-CSF versus Flt3 ligand has implications for inflammation and trafficking. J. Immunology. 2007;179(11):7577-7584.

Xu, et al., The endogenous hydrogen sulfide producing enzyme cystathionine-i synthase contributes to visceral hypersensitivity in a rat model of irritable bowel syndrome. Molecular Pain, Biomed central, London, GB. Aug. 6, 2009; 5(1):p. 44.

Xu, J. et al., "Message from a human gut symbiont: sensitivity is a prerequisite for sharing", Trends in microbiology, 12(1), Jan. 2, 2004: pp. 21-28, XP055253932.

Yang, Changa et al., Non-invasive imaging of toll-like receptor 5 expressing using 131 labelled mAb in the mice bearing H22 tumors, Oncol. Lett. 2014., 7(6).1919-1924., Published online Apr. 2, 2014. DOI: 10.3892/ol.2014.2025.

Yang, J. et al., Targeting Th17 cells in autoimmune diseases. Trends Pharmacol Sci. Oct. 2014;35(10):493-500. doi: 10.1016/j.tips.2014. 07.006. Epub Aug. 14, 2014.

Yao, W., et al., Cultivation-Independent Analysis of the Development of the *Lactobacillus* spp. Community in the Intestinal Tract of NewbornPiglets (2011)Agricultural Sciences in China, 10 (3), pp. 438-447.

Ye, X. et al., The Role of IL-23/Th17 Pathway in Patients with Primary Immune Thrombocytopenia. (2015) PLoS One. 10(1):e0117704.

Yin, X. et al., Combined effect of five single nucleotide polymorphisms related to IL23/Th17 pathway in the risk of psoriasis. lmmunogenetics. Mar. 2014;66(3):215-8. doi: 10.1007/s00251 013-0756-z. Epub Jan. 14, 2014.

Yoon, et al., Structural basis of TLR5-flagellin recognition and signaling. Science. Feb. 2012; 335(6070):859-864.Feb. 17, 2012.

Yoshinori Kohwi et al., "Antitumor Effect of Bifidobacterium Infant's in Mice", Gann, 69, 613--618; Oct. 1978.

Yq et al. Therapeutic Modulation of the Gut Microbiota in IBD—More Questions to be Answered. (2016). J. Dig. Dis., Oct. 15, 1751-2980, 12422, Firstpublished:Oct. 15, 2016.

Yu, Dah-Shyong et al., Bacille Calmette-Guerin can induce cellular apoptosis of urothelial cancer directly through toll-like receptor 7 activation, Kaohsiung Journal of Medical Sciences (2015) 31,391-397.

Yu, et al., Utilization of major fucosylated and sialylated human milk oligosaccharides by isolated human gut microbes. Glycobiology, 2013; 23(11):1281-1292.EpubSep. 7, 2013.

Yu, N.Y., Wagner, J.R., Laird, M.R., Melli, G., Rey, S., Lo, R., et al. (2010a). PSORTb 3.0: improved protein subcellular localization prediction with refined localization subcategories and predictive capabilities for all prokaryotes. Bioinformatics 26(13), 1608-1615. doi: 10.1093/bioinformatics/btq249. EpubMay 13, 2010.

Yun, J.H., et al., Isolation and characterization of potential pro biotic lactobacilli from pig feces (2009). Journal of Basic Microbiology, 49 (2), pp. 220-226.

Yurdusev, N. et al., Antagonistic Effect Exerted by Three Strictly Anaerobic Strains Against Various Strains of Clostridium Perfringens in Gnotobiotic Rodent Intestines. Can J Microbiol 33, 226-231 (1987).

Yurdusev, N. et al., InfectInunun 57,724-731 (1989).

Yutin, N. and Galperin, M.Y., A genomic update on clostridial phylogeny:Gram-negative spore formers and other misplaced clostridia. Environmental microbiology. Oct. 2013; 15(10): 2631-2641. EpubJul. 9, 2013.

Zhang, B. et al., Oral administration of enterococcus faecalis FK-23 suppresses Th17 cell development and attenuates allergic airway responses in mice. International journal of molecular medicine. 2012; 30:248-254. EpubMay 24, 2012.

Zhang, B. et al., The Prevalence of Th17 Cells in Patients With Gastric Cancer. 2008. Biochem Biophys Res Commun 374 (3), 533-537.EpubJul. 23, 2008.

Zhang, et al., The Activation of NF-κB in Infiltrated Mononuclear Cells Negatively Correlates with Treg Cell Frequency in Oral Lichen Planus. Inflammation. Aug. 2015;38(4):1683-9. doi: 10.1007/s10753-015-0145-x.

Zheng, B., van Bergenhenegouwen, J., Overbeek, S., van de Kant, H.J., Garssen, J., Folkerts, G., et al. (2014). Bifidobacterium breve attenuates murine dextran sodium sulfate-induced colitis and increases regulatory T cell responses. PLoS One 9(5), e95441. doi: 10.1371/journal.pone.0095441.May 2, 2014.

Zhongyuan, T. et al., The inflammation regulation effects of enterococcus faecium HDRsEf1 on human enterocyte-like HT-29 cells. Animal cells and systems. Mar. 22, 2016;20(2):70-76.

Zhou et al. Central and peripheral hypersensitivity in the irritable bowel syndrome. 2010. Pain. 148(3): 454-461.EpubJan. 13, 2010.

Zhu, S. and Qian, Y., IL-17/IL-17 receptor system in autoimmune disease: mechanisms and therapeutic potential. Clinical Science (2012) 122, 487-511.

Zitomersky, N. et al., Characterization of Adherent Bacteroidales from Intestinal Biopsies of Children and Young Adults with Inflammatory Bowel Disease. PLOS one. 2013; 8(6).e63686.Published online Jun. 11, 2013.

Zitvogel, et al., Type I interferons in anticancer immunity. Nature Reviews. Jul. 2015:405-414.EpubJun. 1, 2015.

\* cited by examiner

COMPOSITIONS COMPRISING BACTERIAL STRAIN

CROSS-REFERENCE

This application is a continuation of International Application No. PCT/GB2018/051417, filed May 24, 2018, which claims the benefit of Great Britain Application No. 1708312.2, filed May 24, 2017, and Great Britain Application No. 1711369.7, filed Jul. 14, 2017, all of which are hereby incorporated by reference in their entirety.

SEQUENCE LISTING

The instant application contains a Sequence Listing which has been submitted electronically in ANSI format and is hereby incorporated by reference in its entirety. Said ANSI copy, created on Dec. 12, 2019, is named 56708_722_301_SL.txt and is 4,518,095 bytes in size.

TECHNICAL FIELD

This invention is in the field of compositions comprising a bacterial strain isolated from the mammalian digestive tract and the use of such compositions in the treatment of disease.

BACKGROUND TO THE INVENTION

The human intestine is thought to be sterile in utero, but it is exposed to a large variety of maternal and environmental microbes immediately after birth. Thereafter, a dynamic period of microbial colonization and succession occurs, which is influenced by factors such as delivery mode, environment, diet and host genotype, all of which impact upon the composition of the gut microbiota, particularly during early life. Subsequently, the microbiota stabilizes and becomes adult-like [1]. The human gut microbiota contains more than 500-1000 different phylotypes belonging essentially to two major bacterial divisions, the Bacteroidetes and the Firmicutes [2]. The successful symbiotic relationships arising from bacterial colonization of the human gut have yielded a wide variety of metabolic, structural, protective and other beneficial functions. The enhanced metabolic activities of the colonized gut ensure that otherwise indigestible dietary components are degraded with release of by-products providing an important nutrient source for the host. Similarly, the immunological importance of the gut microbiota is well-recognized and is exemplified in germfree animals which have an impaired immune system that is functionally reconstituted following the introduction of commensal bacteria [3-5].

Dramatic changes in microbiota composition have been documented in gastrointestinal disorders such as inflammatory bowel disease (IBD). For example, the levels of *Clostridium* cluster XIVa bacteria are reduced in IBD patients whilst numbers of *E. coli* are increased, suggesting a shift in the balance of symbionts and pathobionts within the gut [6-9]. Interestingly, this microbial dysbiosis is also associated with imbalances in T effector cell populations.

In recognition of the potential positive effect that certain bacterial strains may have on the animal gut, various strains have been proposed for use in the treatment of various diseases (see, for example, [10-13]). Also, certain strains, including mostly *Lactobacillus* and *Bifidobacterium* strains, have been proposed for use in treating various inflammatory and autoimmune diseases that are not directly linked to the intestines (see [14] and [15] for reviews). However, the relationship between different diseases and different bacterial strains, and the precise effects of particular bacterial strains on the gut and at a systemic level and on any particular types of diseases, are poorly characterised. For example, certain *Enterococcus* species have been implicated in causing cancer [16].

There is a requirement in the art for new methods of treating diseases. There is also a requirement for the potential effects of gut bacteria to be characterised so that new therapies using gut bacteria can be developed.

SUMMARY OF THE INVENTION

The inventors have developed new therapies for treating and preventing diseases. In particular, the inventors have developed new therapies for treating and preventing cancer. In particular, the inventors have identified that a bacterial strain of the species *Enterococcus gallinarum* can be effective for treating and preventing cancer. As described in the examples, oral administration of compositions comprising this strain of *Enterococcus gallinarum* may reduce tumor size in mouse models of cancer.

According to a first aspect of the invention, there is provided an *Enterococcus gallinarum* deposited under accession number NCIMB 42761, or a derivative thereof.

In preferred embodiments, the invention provides a composition comprising an *Enterococcus gallinarum* deposited under accession number NCIMB 42761, or a derivative thereof, for use in a method of treating or preventing cancer, such as breast, lung or liver cancer. The inventors have identified that treatment with compositions comprising a bacterial strain of the species *Enterococcus gallinarum* deposited under accession number NCIMB 42761 can reduce tumour growth in mouse models of breast cancer. In certain embodiments, the composition is for use in a method of reducing tumour size or preventing tumour growth in the treatment of cancer. Compositions using the *Enterococcus gallinarum* strain of the invention may be particularly effective for reducing tumour size or preventing tumour growth in the treatment of cancer.

In certain embodiments, the composition of the invention is for oral administration. Oral administration of the strain of the invention can be effective for treating cancer. Also, oral administration is convenient for patients and practitioners and allows delivery to and/or partial or total colonisation of the intestine.

In certain embodiments, the composition of the invention comprises one or more pharmaceutically acceptable excipients or carriers.

In certain embodiments, the composition of the invention comprises a bacterial strain that has been lyophilised. Lyophilisation is an effective and convenient technique for preparing stable compositions that allow delivery of bacteria.

In certain embodiments, the invention provides a food product comprising the composition as described above.

In certain embodiments, the invention provides a vaccine composition comprising the composition as described above.

Additionally, the invention provides a method of treating or preventing cancer, comprising administering a composition comprising a bacterial strain of the species *Enterococcus gallinarum* deposited under accession number NCIMB 42761.

In developing the above invention, the inventors have identified and characterised a bacterial strain that is particularly useful for therapy. The *Enterococcus gallinarum* strain of the invention is shown to be effective for treating cancer. The invention also provides compositions comprising such cells, or biologically pure cultures of such cells. The invention also provides a cell of the *Enterococcus gallinarum* strain deposited under accession number NCIMB 42761, or a derivative thereof, for use in therapy, in particular for cancer.

DISCLOSURE OF THE INVENTION

Bacterial Strain

Figure 1:
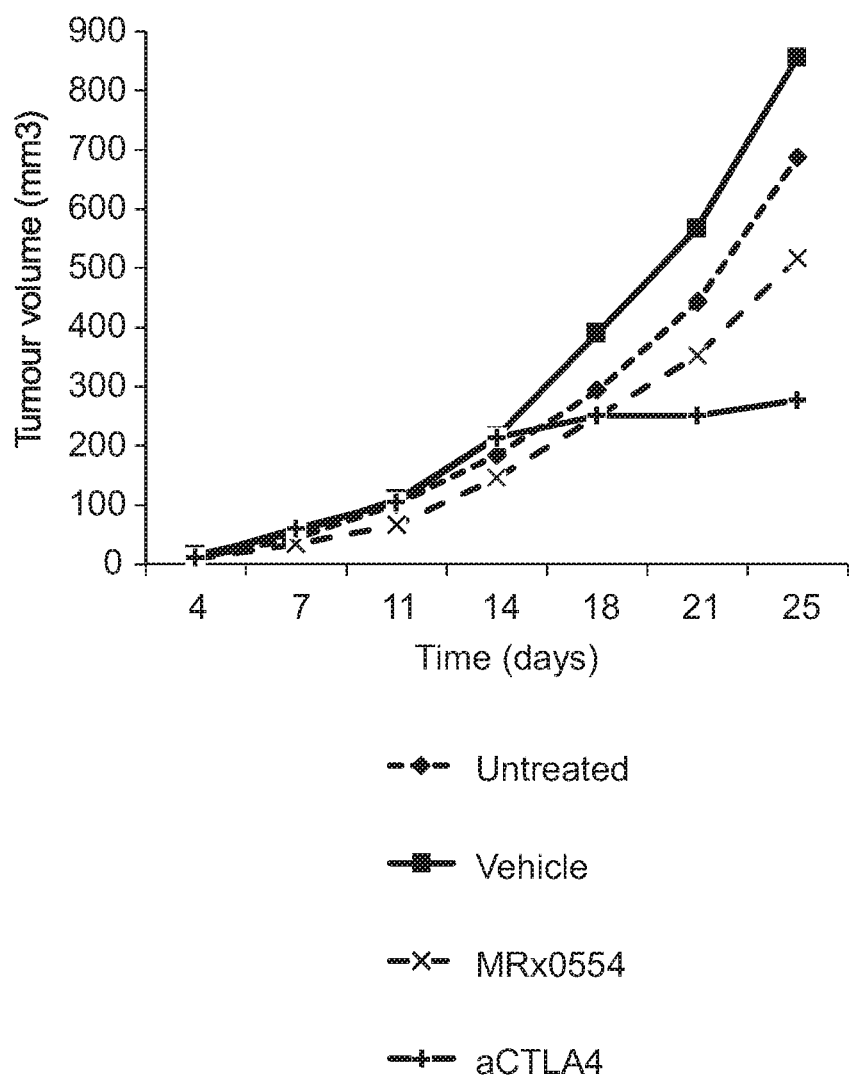
FIG. 1: Mouse model of breast cancer—tumor volume.

The compositions of the invention comprise a bacterial strain of the species *Enterococcus gallinarum* deposited under accession number NCIMB 42761. The examples demonstrate that the bacteria strain is useful for treating or preventing cancer.

The invention provides an *Enterococcus gallinarum* for use in therapy, for example, for use in treating or preventing cancer. Similarly, the invention provides a composition comprising a bacterial strain of the species *Enterococcus gallinarum*, for use in therapy, for example, for use in treating or preventing cancer.

*Enterococcus gallinarum* forms coccoid cells, mostly in pairs or short chains. It is nonmotile and colonies on blood agar or nutrient agar are circular and smooth. *Enterococcus gallinarum* reacts with Lancefield group D antisera. The type strain of *Enterococcus gallinarum* is F87/276=PB21=ATCC 49573=CCUG 18658=CIP 103013=JCM 8728=LMG 13129=NBRC 100675=NCIMB 702313 (formerly NCDO 2313)=NCTC 12359 [17]. The GenBank accession number for a 16S rRNA gene sequence of *Enterococcus gallinarum* is AF039900 (disclosed herein as SEQ ID NO:1). An exemplary *Enterococcus gallinarum* strain is described in [17].

The *Enterococcus gallinarum* bacterium deposited under accession number NCIMB 42761 was tested in the Example and is also referred to herein as strain MRX554. References to MRX554 and MRx0554 are used interchangeably. Strain MRX554 was deposited with the international depositary authority NCIMB, Ltd. (Ferguson Building, Aberdeen, AB21 9YA, Scotland) by 4D Pharma Research Ltd. (Life Sciences Innovation Building, Aberdeen, AB25 2ZS, Scotland) on 22 May 2017 as "*Enterococcus sp*" and was assigned accession number NCIMB 42761. The genome sequence of this bacterium is disclosed herein as SEQ ID NO:2. The genome sequence was assembled from multiple contigs. Ns in the sequence represent gaps between the contigs. "N" may represent an A, G, C or T nucleotide. A 16S rRNA gene sequence for the MRX554 strain is provided in SEQ ID NO:3. SEQ ID NO:3 represents the full length sequence present in the assembly, rather than a consensus of the five 16S genes present in MRX554.

Bacterial strains closely related to the strain tested in the examples are also expected to be effective for treating or preventing cancer. In certain embodiments, the bacterial strain for use in the invention has a 16s rRNA sequence that is at least 95%, 96%, 97%, 98%, 99%, 99.5% or 99.9% identical to the 16s rRNA sequence of the bacterium deposited under accession number NCIMB 42761. Preferably, the bacterial strain for use in the invention has a 16s rRNA gene sequence that is at least 95%, 96%, 97%, 98%, 99%, 99.5% or 99.9% identical to SEQ ID NO:1 or 3. Preferably, the sequence identity is to SEQ ID NO:3. Preferably, the bacterial strain for use in the invention has the 16s rRNA gene sequence represented by SEQ ID NO:3.

Bacterial strains that are biotypes of the bacterium deposited under accession number 42761 are also expected to be effective for treating or preventing cancer. A biotype is a closely related strain that has the same or very similar physiological and biochemical characteristics.

Strains that are biotypes of the bacterium deposited under accession number NCIMB 42761 and that are suitable for use in the invention may be identified by sequencing other nucleotide sequences for the bacterium deposited under accession number NCIMB 42761. For example, substantially the whole genome may be sequenced and a biotype strain for use in the invention may have at least 95%, 96%, 97%, 98%, 99%, 99.5% or 99.9% sequence identity across at least 80% of its whole genome (e.g. across at least 85%, 90%, 95% or 99%, or across its whole genome). For example, in some embodiments, a biotype strain has at least 98% sequence identity across at least 98% of its genome or at least 99% sequence identity across 99% of its genome. Other suitable sequences for use in identifying biotype strains may include hsp60 or repetitive sequences such as BOX, ERIC, (GTG)$_5$, or REP or [18]. Biotype strains may have sequences with at least 95%, 96%, 97%, 98%, 99%, 99.5% or 99.9% sequence identity to the corresponding sequence of the bacterium deposited under accession number NCIMB 42761. In some embodiments, a biotype strain has a sequence with at least 95%, 96%, 97%, 98%, 99%, 99.5% or 99.9% sequence identity to the corresponding sequence of strain MRX554 deposited as NCIMB 42761. In some embodiments, a biotype strain has a sequence with at least 95%, 96%, 97%, 98%, 99%, 99.5% or 99.9% sequence identity to the corresponding sequence of strain MRX554 deposited as NCIMB 42761 and has a 16S rRNA gene sequence that is at least 99% identical (e.g. at least 99.5% or at least 99.9% identical) to SEQ ID NO:3. In some embodiments, a biotype strain has a sequence with at least 95%, 96%, 97%, 98%, 99%, 99.5% or 99.9% sequence identity to the corresponding sequence of strain MRX554 deposited as NCIMB 42761 and has the 16S rRNA gene sequence of SEQ ID NO:3.

Alternatively, strains that are biotypes of the bacterium deposited under accession number NCIMB 42761 and that are suitable for use in the invention may be identified by using the accession number NCIMB 42761 deposit and restriction fragment analysis and/or PCR analysis, for example by using fluorescent amplified fragment length polymorphism (FAFLP) and repetitive DNA element (rep)-PCR fingerprinting, or protein profiling, or partial 16S or 23s rDNA sequencing.

In certain embodiments, strains that are biotypes of the bacterium deposited under accession number NCIMB 42761 and that are suitable for use in the invention are strains that provide the same pattern as the bacterium deposited under accession number NCIMB 42761 when analysed by amplified ribosomal DNA restriction analysis (ARDRA), for example when using Sau3AI restriction enzyme (for exemplary methods and guidance see, for example,[19]). Alternatively, biotype strains are identified as strains that have the same carbohydrate fermentation patterns as the bacterium deposited under accession number NCIMB 42761. In some embodiments, the carbohydrate fermentation pattern is determined using the API 50 CHL panel (bioMérieux). In some embodiments, the bacterial strain used in the invention is:
(i) positive for fermentation of at least one of (e.g. at least 2, 3, 4, 5, 6, 7, 8, 9, 10, 11, 12, 13, 14, 15, 16, 17 or all of): L-arabinose, D-ribose, D-xylose, D-galactose, D-glucose, D-fructose, D-mannose, N-acetylglucosamine, amygdalin, arbutin, salicin, D-cellobiose, D-maltose, sucrose, D-trehalose, gentiobiose, D-tagatose and potassium gluconate; and/or
(ii) intermediate for fermentation of at least one of (e.g. at least 2, 3, 4 or all of): D-mannitol, Methyl-αD-glycopyranoside, D-lactose, starch, and L-fucose;
preferably as determined by API 50 CHL analysis (preferably using the API 50 CHL panel from bioMérieux).

In some embodiments, the bacterial strain used in the invention is:
(i) positive for fermentation of at least one of (e.g. at least 2, 3, 4, 5, 6, 7, 8, 9, 10, 11, 12, 13, 14, 15, 16, 17, 18 or all of): L-arabinose, D-ribose, D-xylose, D-galactose, D-glucose, D-fructose, D-mannose, N-acetylglucosamine, amygdalin, arbutin, esculin, salicin, D-cellobiose, D-maltose, D-saccharose (sucrose), D-trehalose, gentiobiose, D-tagatose and potassium gluconate;
(ii) intermediate for fermentation of at least one of (e.g. at least 2, 3, 4, 5 or all of): D-mannitol, Methyl-αD-glycopyranoside, D-lactose, D-raffinose, amidon (starch), and D-turanose; and/or
(iii) negative for fermentation of at least one of (e.g. at least 2, 3, 4, 5, 6, 7, 8, 9, 10, 11, 12, 13, 14, 15, 16, 17, 18, 19, 20, 21, 22, 23 or all of): glycerol, erythritol, D-arabinose, L-xylose, D-adonitol, methyl-βD-xylopryranoside, L-sorbose, L-rhamnose, dulcitol, inositol, D-sorbitol, Methyl-αD-mannopyranoside, D-melibiose, inulin, D-melezitose, glycogen, xylitol, D-lyxose, D-fucose, L-fucose, D-arabitol, L-arabitol, potassium 2-ketogluconate and potassium 5-ketogluconate;
preferably as determined by API 50 CHL analysis (preferably using the API 50 CHL panel from bioMérieux, and preferably using the conditions described in Example 3).

Other *Enterococcus gallinarum* strains that are useful in the compositions and methods of the invention, such as biotypes of the bacterium deposited under accession number NCIMB 42761, may be identified using any appropriate method or strategy, including the assays described in the examples. For instance, strain for use in the invention may be identified by culturing in anaerobic YCFA and/or administering the bacteria to the type II collagen-induced arthritis mouse model and then assessing cytokine levels. In particular, bacterial strains that have similar growth patterns, metabolic type and/or surface antigens to the bacterium deposited under accession number NCIMB 42761 may be useful in the invention. A useful strain will have comparable immune modulatory activity to the NCIMB 42761 strain. In particular, a biotype strain will elicit comparable effects on the cancer disease models to the effects shown in the Examples, which may be identified by using the culturing and administration protocols described in the Examples.

The invention further provides a cell, such as an isolated cell, of the *Enterococcus gallinarum* strain deposited under accession number NCIMB 42761, or a derivative thereof. The invention also provides a composition comprising a cell of the *Enterococcus gallinarum* strain deposited under accession number NCIMB 42761, or a derivative thereof.

The invention also provides a biologically pure culture of the *Enterococcus gallinarum* strain deposited under accession number NCIMB 42761. The invention also provides a cell of the *Enterococcus gallinarum* strain deposited under accession number NCIMB 42761, or a derivative thereof, for use in therapy, in particular for the diseases described herein. A derivative of the strain deposited under accession number NCIMB 42761 may be a daughter strain (progeny) or a strain cultured (subcloned) from the original.

A derivative of a strain of the invention may be modified, for example at the genetic level, without ablating the biological activity. In particular, a derivative strain of the invention is therapeutically active. A derivative strain will have comparable immune modulatory activity to the original NCIMB 42761 strain. In particular, a derivative strain will elicit comparable effects on the cancer disease models to the effects shown in the Examples, which may be identified by using the culturing and administration protocols described in the Examples. A derivative of the NCIMB 42761 strain will generally be a biotype of the NCIMB 42761 strain.

References to cells of the *Enterococcus gallinarum* strain deposited under accession number NCIMB 42761 encompass any cells that have the same safety and therapeutic efficacy characteristics as the strain deposited under accession number NCIMB 42761, and such cells are encompassed by the invention. Thus, in some embodiments, reference to cells of the *Enterococcus gallinarum* strain deposited under accession number NCIMB 42761 refers only to the MRX554 strain deposited under NCIMB 42761 and does not refer to a bacterial strain that was not deposited under NCIMB 42761.

In certain embodiments, the bacterial strain for use in the invention has a genome with sequence identity to SEQ ID NO:2. In some embodiments, the bacterial strain for use in the invention has a genome with at least 90% sequence identity (e.g. at least 92%, 94%, 95%, 96%, 97%, 98%, 99% or 100% sequence identity) to SEQ ID NO:2 across at least 60% (e.g. across at least 65%, 70%, 75%, 80%, 85%, 95%, 96%, 97%, 98%, 99% or 100%) of SEQ ID NO:2. For example, the bacterial strain for use in the invention may have a genome with at least 90% sequence identity to SEQ ID NO:2 across 70% of SEQ ID NO:2, or at least 90% sequence identity to SEQ ID NO:2 across 80% of SEQ ID NO:2, or at least 90% sequence identity to SEQ ID NO:2 across 90% of SEQ ID NO:2, or at least 90% sequence identity to SEQ ID NO:2 across 100% of SEQ ID NO:2, or at least 95% sequence identity to SEQ ID NO:2 across 70% of SEQ ID NO:2, or at least 95% sequence identity to SEQ ID NO:2 across 80% of SEQ ID NO:2, or at least 95% sequence identity to SEQ ID NO:2 across 90% of SEQ ID NO:2, or at least 95% sequence identity to SEQ ID NO:2 across 100% of SEQ ID NO:2, or at least 98% sequence identity to SEQ ID NO:2 across 70% of SEQ ID NO:2, or at least 98% sequence identity to SEQ ID NO:2 across 80% of SEQ ID NO:2, or at least 98% sequence identity to SEQ ID NO:2 across 90% of SEQ ID NO:2, or at least 98% identity across 95% of SEQ ID NO:2, or at least 98% sequence identity to SEQ ID NO:2 across 100% of SEQ ID NO:2, or at least 99.5% sequence identity to SEQ ID NO:2 across 90% of SEQ ID NO:2, or at least 99.5% identity across 95% of SEQ ID NO:2, or at least 99.5% identity across 98% of SEQ ID NO:2, or at least 99.5% sequence identity to SEQ ID NO:2 across 100% of SEQ ID NO:2.

In certain embodiments, the bacterial strain for use in the invention has a genome with sequence identity to SEQ ID NO:2, for example as described above, and a 16S rRNA gene sequence with sequence identity to SEQ ID NO:1 or 3, for example as described above, preferably with a 16S rRNA gene sequence that is at least 99% identical to SEQ ID NO: 3, more preferably which comprises the 16S rRNA gene sequence of SEQ ID NO:3.

In certain embodiments, the bacterial strain for use in the invention has a genome with sequence identity to SEQ ID NO:2, for example as described above, and is effective for treating or preventing cancer.

In certain embodiments, the bacterial strain for use in the invention has a genome with sequence identity to SEQ ID NO:2, for example as described above, and a 16S rRNA gene sequence with sequence identity to SEQ ID NO: 1 or 3, for example as described above, and is effective for treating or preventing cancer.

In certain embodiments, the bacterial strain for use in the invention has a 16S rRNA gene sequence that is at least 99%, 99.5% or 99.9% identical to the 16S rRNA gene sequence represented by SEQ ID NO: 3 (for example, which comprises the 16S gene rRNA sequence of SEQ ID NO:2) and a genome with at least 95% sequence identity to SEQ ID NO:2 across at least 90% of SEQ ID NO:2, and which is effective for treating or preventing cancer.

In certain embodiments, the bacterial strain for use in the invention is a *Enterococcus gallinarum* and has a 16S rRNA gene sequence that is at least 99%, 99.5% or 99.9% identical to the 16S rRNA gene sequence represented by SEQ ID NO: 3 (for example, which comprises the 16S rRNA gene sequence of SEQ ID NO:3) and a genome with at least 98% sequence identity (e.g. at least 99% or at least 99.5% sequence identity) to SEQ ID NO:2 across at least 98% (e.g. across at least 99% or at least 99.5%) of SEQ ID NO:2, and which is effective for treating or preventing cancer.

In preferred embodiments, the bacterial strain in the compositions of the invention is viable and capable of partially or totally colonising the intestine.

Treating Cancer

In preferred embodiments, the compositions of the invention are for use in treating or preventing cancer. The examples demonstrate that administration of the compositions of the invention can lead to a reduction in tumour growth in tumour models.

In certain embodiments, treatment with the compositions of the invention results in a reduction in tumour size or a reduction in tumour growth. In certain embodiments, the compositions of the invention are for use in reducing tumour size or reducing tumour growth. The compositions of the invention may be effective for reducing tumour size or growth. In certain embodiments, the compositions of the invention are for use in patients with solid tumours. In certain embodiments, the compositions of the invention are for use in reducing or preventing angiogenesis in the treatment of cancer. The compositions of the invention may have an effect on the immune or inflammatory systems, which have central roles in angiogenesis. In certain embodiments, the compositions of the invention are for use in preventing metastasis.

In preferred embodiments, the compositions of the invention are for use in treating or preventing breast cancer. The examples demonstrate that the compositions of the invention may be effective for treating breast cancer. In certain embodiments, the compositions of the invention are for use in reducing tumour size, reducing tumour growth, or reducing angiogenesis in the treatment of breast cancer. In preferred embodiments the cancer is mammary carcinoma. In preferred embodiments the cancer is stage IV breast cancer.

In certain embodiments, the compositions of the invention are for use in treating or preventing lung cancer. The compositions of the invention may be effective for treating lung cancer. In certain embodiments, the compositions of the invention are for use in reducing tumour size, reducing tumour growth, or reducing angiogenesis in the treatment of lung cancer. In preferred embodiments the cancer is lung carcinoma.

In certain embodiments, the compositions of the invention are for use in treating or preventing liver cancer. The compositions of the invention may be effective for treating liver cancer. In certain embodiments, the compositions of the invention are for use in reducing tumour size, reducing tumour growth, or reducing angiogenesis in the treatment of liver cancer. In preferred embodiments the cancer is hepatoma (hepatocellular carcinoma).

In certain embodiments, the compositions of the invention are for use in treating or preventing colon cancer. The compositions of the invention may have an effect on colon cancer cells and may be effective for treating colon cancer. In certain embodiments, the compositions of the invention are for use in reducing tumour size, reducing tumour growth, or reducing angiogenesis in the treatment of colon cancer. In preferred embodiments the cancer is colorectal adenocarcinoma.

In some embodiments, the cancer is of the intestine. In some embodiments, the cancer is of a part of the body which is not the intestine. In some embodiments, the cancer is not cancer of the intestine. In some embodiments, the cancer is not colorectal cancer. In some embodiments, the cancer is not cancer of the small intestine. In some embodiments, the treating or preventing occurs at a site other than at the intestine. In some embodiments, the treating or preventing occurs at the intestine and also at a site other than at the intestine.

In certain embodiments, the compositions of the invention are for use in treating or preventing carcinoma. The compositions of the invention may be effective for treating numerous types of carcinoma. In certain embodiments, the compositions of the invention are for use in treating or preventing non-immunogenic cancer. The examples demonstrate that the compositions of the invention may be effective for treating non-immunogenic cancers.

The therapeutic effects of the compositions of the invention on cancer may be mediated by a pro-inflammatory mechanism. The expression of a number of pro-inflammatory cytokines may be increased following administration of MRX554. Inflammation can have a cancer-suppressive effect [20] and pro-inflammatory cytokines such as TNFα are being investigated as cancer therapies [21]. The up-regulation of genes such as TNF may indicate that the compositions of the invention may be useful for treating cancer via a similar mechanism. The up-regulation of CXCR3 ligands (CXCL9, CXCL10) and IFNγ-inducible genes (IL-32) may indicate that the compositions of the invention elicit an IFNγ-type response. IFNγ is a potent macrophage-activating factor that can stimulate tumirocidal activity [22], and CXCL9 and CXCL10, for example, also have anti-cancer effects [23-25]. Therefore, in certain embodiments, the compositions of the invention are for use in promoting inflammation in the treatment of cancer. In preferred embodiments, the compositions of the invention are for use in promoting Th1 inflammation in the treatment of cancer. Th1 cells produce IFNγ and have potent anti-cancer effects [20]. In certain embodiments, the compositions of the invention are for use in treating an early-stage cancer, such as a cancer that has not metastasized, or a stage 0 or stage 1 cancer. Promoting inflammation may be more effective against early-stage cancers [20]. In certain embodiments, the compositions of the invention are for enhancing the effect of a second anti-cancer agent. In certain embodiments, the compositions of the invention are for use in promoting inflammation to enhance the effect of a second anti-cancer agent. In certain embodiments, the treatment or prevention of cancer comprises increasing the level of expression of one or more cytokines. For example, in certain embodiments, the treatment or prevention of cancer comprises increasing the level of expression of one or more of IL-1β, IL-6 and TNF-α, for example, IL-1β and IL-6, IL-1β and TNF-α, IL-6 and TNF-α or all three of IL-1β, IL-6 and TNF-α. Increases in levels of expression of any of IL-1β, IL-6 and TNF-α are known to be indicative of efficacy in treatment of cancer.

When a bacterial strain as described herein is used in combination with lipopolysaccharide (LPS), there may be a synergistic increase in IL-1β. LPS is known to elicit a pro-inflammatory effect. Thus, in certain embodiments, the treatment or prevention comprises using a bacterial strain as described herein in combination with an agent that upregulates IL-1β. In certain embodiments, the treatment or prevention comprises using a bacterial strain as described herein in combination with LPS. Accordingly, a composition of the invention may additionally comprise an agent that upregulates IL-1β. Accordingly, a composition of the invention may additionally comprise LPS.

In certain embodiments, the compositions of the invention are for use in treating a patient that has previously received chemotherapy. In certain embodiments, the compositions of the invention are for use in treating a patient that has not tolerated a chemotherapy treatment. The compositions of the invention may be particularly suitable for such patients.

In certain embodiments, the compositions of the invention are for preventing relapse. The compositions of the invention may be suitable for long-term administration. In certain embodiments, the compositions of the invention are for use in preventing progression of cancer.

In certain embodiments, the compositions of the invention are for use in treating non-small-cell lung carcinoma. In certain embodiments, the compositions of the invention are for use in treating small-cell lung carcinoma. In certain embodiments, the compositions of the invention are for use in treating squamous-cell carcinoma. In certain embodiments, the compositions of the invention are for use in treating adenocarcinoma. In certain embodiments, the compositions of the invention are for use in treating glandular tumors, carcinoid tumors, or undifferentiated carcinomas.

In certain embodiments, the compositions of the invention are for use in treating hepatoblastoma, cholangiocarcinoma, cholangiocellular cystadenocarcinoma or liver cancer resulting from a viral infection.

In certain embodiments, the compositions of the invention are for use in treating invasive ductal carcinoma, ductal carcinoma in situ or invasive lobular carcinoma.

In further embodiments, the compositions of the invention are for use in treating or preventing acute lymphoblastic leukemia (ALL), acute myeloid leukemia, adrenocortical carcinoma, basal-cell carcinoma, bile duct cancer, bladder cancer, bone tumor, osteosarcoma/malignant fibrous histiocytoma, brainstem glioma, brain tumor, cerebellar astrocytoma, cerebral astrocytoma/malignant glioma, ependymoma, medulloblastoma, supratentorial primitive neuroectodermal tumors, breast cancer, bronchial adenomas/carcinoids, Burkitt's lymphoma, carcinoid tumor, cervical cancer, chronic lymphocytic leukemia, chronic myelogenous leukemia, chronic myeloproliferative disorders, colon cancer, cutaneous T-cell lymphoma, endometrial cancer, ependymoma, esophageal cancer, Ewing's sarcoma, intraocular melanoma, retinoblastoma, gallbladder cancer, gastric cancer, gastrointestinal carcinoid tumor, gastrointestinal stromal tumor (GIST), germ cell tumor, glioma, childhood visual pathway and hypothalamic, Hodgkin lymphoma, melanoma, islet cell carcinoma, Kaposi sarcoma, renal cell cancer, laryngeal cancer, leukaemias, lymphomas, mesothelioma, neuroblastoma, non-Hodgkin lymphoma, oropharyngeal cancer, osteosarcoma, ovarian cancer, pancreatic cancer, parathyroid cancer, pharyngeal cancer, pituitary adenoma, plasma cell neoplasia, prostate cancer, renal cell carcinoma, retinoblastoma, sarcoma, testicular cancer, thyroid cancer, or uterine cancer.

The compositions of the invention may be particularly effective when used in combination with further therapeutic agents. The immune-modulatory effects of the compositions of the invention may be effective when combined with more direct anti-cancer agents. Therefore, in certain embodiments, the invention provides a composition comprising the bacterial strain of the species *Enterococcus gallinarum* and an anticancer agent. In certain embodiments, the composition of the invention comprising the bacterial strain of the species *Enterococcus gallinarum* is for use in stimulating a cancer to enhance its susceptibility to treatment with a second anti-cancer agent. In certain embodiments, the composition of the invention comprising the bacterial strain of the species *Enterococcus gallinarum* is for use in treating a cancer, such as a breast cancer, by enhancing its susceptibility to treatment with a second anti-cancer agent. The second antic-cancer agent may be administered concurrently, or may be administered after the composition comprising the bacterial strain of the species *Enterococcus gallinarum*, such as at least a day, a week, or a month after.

In preferred embodiments the anticancer agent is an immune checkpoint inhibitor, a targeted antibody immunotherapy, a CAR-T cell therapy, an oncolytic virus, or a cytostatic drug. In preferred embodiments, the composition comprises an anti-cancer agent selected from the group consisting of: Yervoy (ipilimumab, BMS); Keytruda (pembrolizumab, Merck); Opdivo (nivolumab, BMS); MEDI4736 (AZ/MedImmune); MPDL3280A (Roche/Genentech); Tremelimumab (AZ/MedImmune); CT-011 (pidilizumab, CureTech); BMS-986015 (lirilumab, BMS); MEDI0680 (AZ/MedImmune); MSB-0010718C (Merck); PF-05082566 (Pfizer); MEDI6469 (AZ/MedImmune); BMS-986016 (BMS); BMS-663513 (urelumab, BMS); IMP321 (Prima Biomed); LAG525 (Novartis); ARGX-110 (arGEN-X); PF-05082466 (Pfizer); CDX-1127 (varlilumab; CellDex Therapeutics); TRX-518 (GITR Inc.); MK-4166 (Merck); JTX-2011 (Jounce Therapeutics); ARGX-115 (arGEN-X); NLG-9189 (indoximod, NewLink Genetics); INCB024360 (Incyte); IPH2201 (Innate Immotherapeutics/AZ); NLG-919 (NewLink Genetics); anti-VISTA (JnJ); Epacadostat (INCB24360, Incyte); F001287 (Flexus/BMS); CP 870893 (University of Pennsylvania); MGA271 (Macrogenix); Emactuzumab (Roche/Genentech); Galunisertib (Eli Lilly); Ulocuplumab (BMS); BKT140/BL8040 (Biokine Therapeutics); Bavituximab (Peregrine Pharmaceuticals); CC 90002 (Celgene); 852A (Pfizer); VTX-2337 (VentiRx Pharmaceuticals); IMO-2055 (Hybridon, Idera Pharmaceuticals); LY2157299 (Eli Lilly); EW-7197 (Ewha Women's University, Korea); Vemurafenib (Plexxikon); Dabrafenib (Genentech/GSK); BMS-777607 (BMS); BLZ945 (Memorial Sloan-Kettering Cancer Centre); Unituxin (dinutuximab, United Therapeutics Corporation);

Blincyto (blinatumomab, Amgen); Cyramza (ramucirumab, Eli Lilly); Gazyva (obinutuzumab, Roche/Biogen); Kadcyla (ado-trastuzumab emtansine, Roche/Genentech); Perjeta (pertuzumab, Roche/Genentech); Adcetris (brentuximab vedotin, Takeda/Millennium); Arzerra (ofatumumab, GSK); Vectibix (panitumumab, Amgen); Avastin (bevacizumab, Roche/Genentech); Erbitux (cetuximab, BMS/Merck); Bexxar (tositumomab-I131, GSK); Zevalin (ibritumomab tiuxetan, Biogen); Campath (alemtuzumab, Bayer); Mylotarg (gemtuzumab ozogamicin, Pfizer); Herceptin (trastuzumab, Roche/Genentech); Rituxan (rituximab, Genentech/Biogen); volociximab (Abbvie); Enavatuzumab (Abbvie); ABT-414 (Abbvie); Elotuzumab (Abbvie/BMS); ALX-0141 (Ablynx); Ozaralizumab (Ablynx); Actimab-C (Actinium); Actimab-P (Actinium); Milatuzumab-dox (Actinium); Emab-SN-38 (Actinium); Naptumonmab estafenatox (Active Biotech); AFM13 (Affimed); AFM11 (Affimed); AGS-16C3F (Agensys); AGS-16M8F (Agensys); AGS-22ME (Agensys); AGS-15ME (Agensys); GS-67E (Agensys); ALXN6000 (samalizumab, Alexion); ALT-836 (Altor Bioscience); ALT-801 (Altor Bioscience); ALT-803 (Altor Bioscience); AMG780 (Amgen); AMG 228 (Amgen); AMG820 (Amgen); AMG172 (Amgen); AMG595 (Amgen); AMG110 (Amgen); AMG232 (adecatumumab, Amgen); AMG211 (Amgen/MedImmune); BAY20-10112 (Amgen/Bayer); Rilotumumab (Amgen); Denosumab (Amgen); AMP-514 (Amgen); MEDI575 (AZ/MedImmune); MEDI3617 (AZ/MedImmune); MEDI6383 (AZ/MedImmune); MEDI551 (AZ/MedImmune); Moxetumomab pasudotox (AZ/MedImmune); MEDI565 (AZ/MedImmune); MEDI0639 (AZ/MedImmune); MEDI0680 (AZ/MedImmune); MEDI562 (AZ/MedImmune); AV-380 (AVEO); AV203 (AVEO); AV299 (AVEO); BAY79-4620 (Bayer); Anetumab ravtansine (Bayer); vantictumab (Bayer); BAY94-9343 (Bayer); Sibrotuzumab (Boehringer Ingleheim); BI-836845 (Boehringer Ingleheim); B-701 (BioClin); BIIB015 (Biogen); Obinutuzumab (Biogen/Genentech); BI-505 (Bioinvent); BI-1206 (Bioinvent); TB-403 (Bioinvent); BT-062 (Biotest) BIL-010t (Biosceptre); MDX-1203 (BMS); MDX-1204 (BMS); Necitumumab (BMS); CAN-4 (Cantargia AB); CDX-011 (Celldex); CDX1401 (Celldex); CDX301 (Celldex); U3-1565 (Daiichi Sankyo); patritumab (Daiichi Sankyo); tigatuzumab (Daiichi Sankyo); nimotuzumab (Daiichi Sankyo); DS-8895 (Daiichi Sankyo); DS-8873 (Daiichi Sankyo); DS-5573 (Daiichi Sankyo); MORab-004 (Eisai); MORab-009 (Eisai); MORab-003 (Eisai); MORab-066 (Eisai); LY3012207 (Eli Lilly); LY2875358 (Eli Lilly); LY2812176 (Eli Lilly); LY3012217 (Eli Lilly); LY2495655 (Eli Lilly); LY3012212 (Eli Lilly); LY3012211 (Eli Lilly); LY3009806 (Eli Lilly); cixutumumab (Eli Lilly); Flanvotumab (Eli Lilly); IMC-TR1 (Eli Lilly); Ramucirumab (Eli Lilly); Tabalumab (Eli Lilly); Zanolimumab (Emergent Biosolution); FG-3019 (FibroGen); FPA008 (Five Prime Therapeutics); FP-1039 (Five Prime Therapeutics); FPA144 (Five Prime Therapeutics); catumaxomab (Fresenius Biotech); IMAB362 (Ganymed); IMAB027 (Ganymed); HuMax-CD74 (Genmab); HuMax-TFADC (Genmab); GS-5745 (Gilead); GS-6624 (Gilead); OMP-21M18 (demcizumab, GSK); mapatumumab (GSK); IMGN289 (ImmunoGen); IMGN901 (ImmunoGen); IMGN853 (ImmunoGen); IMGN529 (ImmunoGen); IMMU-130 (Immunomedics); milatuzumab-dox (Immunomedics); IMMU-115 (Immunomedics); IMMU-132 (Immunomedics); IMMU-106 (Immunomedics); IMMU-102 (Immunomedics); Epratuzumab (Immunomedics); Clivatuzumab (Immunomedics); IPH41 (Innate Immunotherapeutics); Daratumumab (Janssen/Genmab); CNTO-95 (Intetumumab, Janssen); CNTO-328 (siltuximab, Janssen); KB004 (KaloBios); mogamulizumab (Kyowa Hakko Kirrin); KW-2871 (ecromeximab, Life Science); Sonepcizumab (Lpath); Margetuximab (Macrogenics); Enoblituzumab (Macrogenics); MGD006 (Macrogenics); MGF007 (Macrogenics); MK-0646 (dalotuzumab, Merck); MK-3475 (Merck); Sym004 (Symphogen/Merck Serono); DI17E6 (Merck Serono); MOR208 (Morphosys); MOR202 (Morphosys); Xmab5574 (Morphosys); BPC-1C (ensituximab, Precision Biologics); TAS266 (Novartis); LFA102 (Novartis); BHQ880 (Novartis/Morphosys); QGE031 (Novartis); HCD122 (lucatumumab, Novartis); LJM716 (Novartis); AT355 (Novartis); OMP-21M18 (Demcizumab, OncoMed); OMP52M51 (Oncomed/GSK); OMP-59R5 (Oncomed/GSK); vantictumab (Oncomed/Bayer); CMC-544 (inotuzumab ozogamicin, Pfizer); PF-03446962 (Pfizer); PF-04856884 (Pfizer); PSMA-ADC (Progenics); REGN1400 (Regeneron); REGN910 (nesvacumab, Regeneron/Sanofi); REGN421 (enoticumab, Regeneron/Sanofi); RG7221, RG7356, RG7155, RG7444, RG7116, RG7458, RG7598, RG7599, RG7600, RG7636, RG7450, RG7593, RG7596, DCDS3410A, RG7414 (parsatuzumab), RG7160 (imgatuzumab), RG7159 (obinutuzumab), RG7686, RG3638 (onartuzumab), RG7597 (Roche/Genentech); SAR307746 (Sanofi); SAR566658 (Sanofi); SAR650984 (Sanofi); SAR153192 (Sanofi); SAR3419 (Sanofi); SAR256212 (Sanofi), SGN-LIV1A (lintuzumab, Seattle Genetics); SGN-CD33A (Seattle Genetics); SGN-75 (vorsetuzumab mafodotin, Seattle Genetics); SGN-19A (Seattle Genetics) SGN-CD70A (Seattle Genetics); SEA-CD40 (Seattle Genetics); ibritumomab tiuxetan (Spectrum); MLN0264 (Takeda); ganitumab (Takeda/Amgen); CEP-37250 (Teva); TB-403 (Thrombogenic); VB4-845 (Viventia); Xmab2512 (Xencor); Xmab5574 (Xencor); nimotuzumab (YM Biosciences); Carlumab (Janssen); NY-ESO TCR (Adaptimmune); MAGE-A-10 TCR (Adaptimmune); CTL019 (Novartis); JCAR015 (Juno Therapeutics); KTE-C19 CAR (Kite Pharma); UCART19 (Cellectis); BPX-401 (Bellicum Pharmaceuticals); BPX-601 (Bellicum Pharmaceuticals); ATTCK20 (Unum Therapeutics); CAR-NKG2D (Celyad); Onyx-015 (Onyx Pharmaceuticals); H101 (Shanghai Sunwaybio); DNX-2401 (DNAtrix); VCN-01 (VCN Biosciences); Colo-Ad1 (PsiOxus Therapeutics); ProstAtak (Advantagene); Oncos-102 (Oncos Therapeutics); CG0070 (Cold Genesys); Pexa-vac (JX-594, Jennerex Biotherapeutics); GL-ONC1 (Genelux); T-VEC (Amgen); G207 (Medigene); HF10 (Takara Bio); SEPREHVIR (HSV1716, Virttu Biologics); OrienX010 (OrienGene Biotechnology); Reolysin (Oncolytics Biotech); SVV-001 (Neotropix); Cacatak (CVA21, Viralytics); Alimta (Eli Lilly), cisplatin, oxaliplatin, irinotecan, folinic acid, methotrexate, cyclophosphamide, 5-fluorouracil, Zykadia (Novartis), Tafinlar (GSK), Xalkori (Pfizer), Iressa (AZ), Gilotrif (Boehringer Ingelheim), Tarceva (Astellas Pharma), Halaven (Eisai Pharma), Veliparib (Abbvie), AZD9291 (AZ), Alectinib (Chugai), LDK378 (Novartis), Genetespib (Synta Pharma), Tergenpumatucel-L (NewLink Genetics), GV1001 (Kael-GemVax), Tivantinib (ArQule); Cytoxan (BMS); Oncovin (Eli Lilly); Adriamycin (Pfizer); Gemzar (Eli Lilly); Xeloda (Roche); Ixempra (BMS); Abraxane (Celgene); Trelstar (Debiopharm); Taxotere (Sanofi); Nexavar (Bayer); IMMU-132 (Immunomedics); E7449 (Eisai); Thermodox (Celsion); Cometriq (Exellxis); Lonsurf (Taiho Pharmaceuticals); Camptosar (Pfizer); UFT (Taiho Pharmaceuticals); and TS-1 (Taiho Pharmaceuticals).

In some embodiments, the bacterial strain of *Enterococcus gallinarum* deposited under accession number NCIMB 42761 is the only therapeutically active agent in a composition of the invention.

Modes of Administration

Preferably, the compositions of the invention are to be administered to the gastrointestinal tract in order to enable delivery to and/or partial or total colonisation of the intestine with the bacterial strain of the invention. Generally, the compositions of the invention are administered orally, but they may be administered rectally, intranasally, or via buccal or sublingual routes.

In certain embodiments, the compositions of the invention may be administered as a foam, as a spray or a gel.

In certain embodiments, the compositions of the invention may be administered as a suppository, such as a rectal suppository, for example in the form of a theobroma oil (cocoa butter), synthetic hard fat (e.g. suppocire, witepsol), glycero-gelatin, polyethylene glycol, or soap glycerin composition.

In certain embodiments, the composition of the invention is administered to the gastrointestinal tract via a tube, such as a nasogastric tube, orogastric tube, gastric tube, jejunostomy tube (J tube), percutaneous endoscopic gastrostomy (PEG), or a port, such as a chest wall port that provides access to the stomach, jejunum and other suitable access ports.

The compositions of the invention may be administered once, or they may be administered sequentially as part of a treatment regimen. In certain embodiments, the compositions of the invention are to be administered daily.

In certain embodiments of the invention, treatment according to the invention is accompanied by assessment of the patient's gut microbiota. Treatment may be repeated if delivery of and/or partial or total colonisation with the strain of the invention is not achieved such that efficacy is not observed, or treatment may be ceased if delivery and/or partial or total colonisation is successful and efficacy is observed.

In certain embodiments, the composition of the invention may be administered to a pregnant animal, for example a mammal such as a human in order to reduce the likelihood of cancer developing in her child in utero and/or after it is born.

The compositions of the invention may be administered to a patient that has been diagnosed with cancer, or that has been identified as being at risk of a cancer. The compositions may also be administered as a prophylactic measure to prevent the development of cancer in a healthy patient.

The compositions of the invention may be administered to a patient that has been identified as having an abnormal gut microbiota. For example, the patient may have reduced or absent colonisation by *Enterococcus gallinarum*.

The compositions of the invention may be administered as a food product, such as a nutritional supplement.

Generally, the compositions of the invention are for the treatment of humans, although they may be used to treat animals including monogastric mammals such as poultry, pigs, cats, dogs, horses or rabbits. The compositions of the invention may be useful for enhancing the growth and performance of animals. If administered to animals, oral gavage may be used.

Compositions

Generally, the composition of the invention comprises bacteria. In preferred embodiments of the invention, the composition is formulated in freeze-dried form. For example, the composition of the invention may comprise granules or gelatin capsules, for example hard gelatin capsules, comprising a bacterial strain of the invention.

Preferably, the composition of the invention comprises lyophilised bacteria. Lyophilisation of bacteria is a well-established procedure and relevant guidance is available in, for example, references [26-28].

Alternatively, the composition of the invention may comprise a live, active bacterial culture.

In some embodiments, the bacterial strain in the composition of the invention has not been inactivated, for example, has not been heat-inactivated. In some embodiments, the bacterial strain in the composition of the invention has not been killed, for example, has not been heat-killed. In some embodiments, the bacterial strain in the composition of the invention has not been attenuated, for example, has not been heat-attenuated. For example, in some embodiments, the bacterial strain in the composition of the invention has not been killed, inactivated and/or attenuated. For example, in some embodiments, the bacterial strain in the composition of the invention is live. For example, in some embodiments, the bacterial strain in the composition of the invention is viable. For example, in some embodiments, the bacterial strain in the composition of the invention is capable of partially or totally colonising the intestine. For example, in some embodiments, the bacterial strain in the composition of the invention is viable and capable of partially or totally colonising the intestine.

In some embodiments, the composition comprises a mixture of live bacterial strains and bacterial strains that have been killed.

In preferred embodiments, the composition of the invention is encapsulated to enable delivery of the bacterial strain to the intestine. Encapsulation protects the composition from degradation until delivery at the target location through, for example, rupturing with chemical or physical stimuli such as pressure, enzymatic activity, or physical disintegration, which may be triggered by changes in pH. Any appropriate encapsulation method may be used. Exemplary encapsulation techniques include entrapment within a porous matrix, attachment or adsorption on solid carrier surfaces, self-aggregation by flocculation or with cross-linking agents, and mechanical containment behind a microporous membrane or a microcapsule. Guidance on encapsulation that may be useful for preparing compositions of the invention is available in, for example, references [29] and [30].

The composition may be administered orally and may be in the form of a tablet, capsule or powder. Encapsulated products are preferred because *Enterococcus gallinarum* are anaerobes. Other ingredients (such as vitamin C, for example), may be included as oxygen scavengers and prebiotic substrates to improve the delivery and/or partial or total colonisation and survival in vivo. Alternatively, the probiotic composition of the invention may be administered orally as a food or nutritional product, such as milk or whey based fermented dairy product, or as a pharmaceutical product.

The composition may be formulated as a probiotic.

A composition of the invention includes a therapeutically effective amount of a bacterial strain of the invention. A therapeutically effective amount of a bacterial strain is sufficient to exert a beneficial effect upon a patient. A therapeutically effective amount of a bacterial strain may be sufficient to result in delivery to and/or partial or total colonisation of the patient's intestine.

A suitable daily dose of the bacteria, for example for an adult human, may be from about $1\times10^3$ to about $1\times10^{11}$ colony forming units (CFU); for example, from about $1\times10^7$ to about $1\times10^{10}$ CFU; in another example from about $1\times10^6$ to about $1\times10^{10}$ CFU.

In certain embodiments, the composition contains the bacterial strain in an amount of from about $1\times10^6$ to about $1\times10^{11}$ CFU/g, respect to the weight of the composition; for example, from about $1\times10^8$ to about $1\times10^{10}$ CFU/g. The dose may be, for example, 1 g, 3 g, 5 g, and 10 g.

Typically, a probiotic, such as the composition of the invention, is optionally combined with at least one suitable prebiotic compound. A prebiotic compound is usually a non-digestible carbohydrate such as an oligo- or polysaccharide, or a sugar alcohol, which is not degraded or absorbed in the upper digestive tract. Known prebiotics include commercial products such as inulin and transgalacto-oligosaccharides.

In certain embodiments, the probiotic composition of the present invention includes a prebiotic compound in an amount of from about 1 to about 30% by weight, respect to the total weight composition, (e.g. from 5 to 20% by weight). Carbohydrates may be selected from the group consisting of: fructo-oligosaccharides (or FOS), short-chain fructo-oligosaccharides, inulin, isomalt-oligosaccharides, pectins, xylo-oligosaccharides (or XOS), chitosan-oligosaccharides (or COS), beta-glucans, arable gum modified and resistant starches, polydextrose, D-tagatose, acacia fibers, carob, oats, and citrus fibers. In one aspect, the prebiotics are the short-chain fructo-oligosaccharides (for simplicity shown herein below as FOSs-c.c); said FOSs-c.c. are not digestible carbohydrates, generally obtained by the conversion of the beet sugar and including a saccharose molecule to which three glucose molecules are bonded.

The compositions of the invention may comprise pharmaceutically acceptable excipients or carriers. Examples of such suitable excipients may be found in the reference [31]. Acceptable carriers or diluents for therapeutic use are well known in the pharmaceutical art and are described, for example, in reference [32]. Examples of suitable carriers include lactose, starch, glucose, methyl cellulose, magnesium stearate, mannitol, sorbitol and the like. Examples of suitable diluents include ethanol, glycerol and water. The choice of pharmaceutical carrier, excipient or diluent can be selected with regard to the intended route of administration and standard pharmaceutical practice. The pharmaceutical compositions may comprise as, or in addition to, the carrier, excipient or diluent any suitable binder(s), lubricant(s), suspending agent(s), coating agent(s), solubilising agent(s). Examples of suitable binders include starch, gelatin, natural sugars such as glucose, anhydrous lactose, free-flow lactose, beta-lactose, corn sweeteners, natural and synthetic gums, such as acacia, tragacanth or sodium alginate, carboxymethyl cellulose and polyethylene glycol. Examples of suitable lubricants include sodium oleate, sodium stearate, magnesium stearate, sodium benzoate, sodium acetate, sodium chloride and the like. Preservatives, stabilizers, dyes and even flavouring agents may be provided in the pharmaceutical composition. Examples of preservatives include sodium benzoate, sorbic acid and esters of p-hydroxybenzoic acid. Antioxidants and suspending agents may be also used.

The compositions of the invention may be formulated as a food product. For example, a food product may provide nutritional benefit in addition to the therapeutic effect of the invention, such as in a nutritional supplement. Similarly, a food product may be formulated to enhance the taste of the composition of the invention or to make the composition more attractive to consume by being more similar to a common food item, rather than to a pharmaceutical composition. In certain embodiments, the composition of the invention is formulated as a milk-based product. The term "milk-based product" means any liquid or semi-solid milk- or whey-based product having a varying fat content. The milk-based product can be, e.g., cow's milk, goat's milk, sheep's milk, skimmed milk, whole milk, milk recombined from powdered milk and whey without any processing, or a processed product, such as yoghurt, curdled milk, curd, sour milk, sour whole milk, butter milk and other sour milk products. Another important group includes milk beverages, such as whey beverages, fermented milks, condensed milks, infant or baby milks; flavoured milks, ice cream; milk-containing food such as sweets.

In certain embodiments, the compositions of the invention contain a single bacterial strain or species and do not contain any other bacterial strains or species. Such compositions may comprise only de minimis or biologically irrelevant amounts of other bacterial strains or species. Such compositions may be a culture that is substantially free from other species of organism. Thus, in some embodiments, the invention provides a composition comprising one or more strains from the species *Enterococcus gallinarum*, which does not contain bacteria from any other species or which comprises only de minimis or biologically irrelevant amounts of bacteria from another species for use in therapy.

In some embodiments, the compositions of the invention comprise more than one bacterial strain or species. For example, in some embodiments, the compositions of the invention comprise more than one strain from within the same species (e.g. more than 1, 2, 3, 4, 5, 6, 7, 8, 9, 10, 15, 20, 25, 30, 35, 40 or 45 strains), and, optionally, do not contain bacteria from any other species. In some embodiments, the compositions of the invention comprise less than 50 strains from within the same species (e.g. less than 45, 40, 35, 30, 25, 20, 15, 12, 10, 9, 8, 7, 6, 5, 4 or 3 strains), and, optionally, do not contain bacteria from any other species. In some embodiments, the compositions of the invention comprise 1-40, 1-30, 1-20, 1-19, 1-18, 1-15, 1-10, 1-9, 1-8, 1-7, 1-6, 1-5, 1-4, 1-3, 1-2, 2-50, 2-40, 2-30, 2-20, 2-15, 2-10, 2-5, 6-30, 6-15, 16-25, or 31-50 strains from within the same species and, optionally, do not contain bacteria from any other species. In some embodiments, the compositions of the invention comprise more than one species from within the same genus (e.g. more than 1, 2, 3, 4, 5, 6, 7, 8, 9, 10, 12, 15, 17, 20, 23, 25, 30, 35 or 40 species), and, optionally, do not contain bacteria from any other genus. In some embodiments, the compositions of the invention comprise less than 50 species from within the same genus (e.g. less than 50, 45, 40, 35, 30, 25, 20, 15, 12, 10, 8, 7, 6, 5, 4 or 3 species), and, optionally, do not contain bacteria from any other genus. In some embodiments, the compositions of the invention comprise 1-50, 1-40, 1-30, 1-20, 1-15, 1-10, 1-9, 1-8, 1-7, 1-6, 1-5, 1-4, 1-3, 1-2, 2-50, 2-40, 2-30, 2-20, 2-15, 2-10, 2-5, 6-30, 6-15, 16-25, or 31-50 species from within the same genus and, optionally, do not contain bacteria from any other genus. The invention comprises any combination of the foregoing.

In some embodiments, the composition comprises a microbial consortium. For example, in some embodiments, the composition comprises the bacterial strain of *Enterococcus gallinarum* deposited under accession number NCIMB 42761, as part of a microbial consortium. For example, in some embodiments, the bacterial strain is present in combination with one or more (e.g. at least 2, 3, 4, 5, 10, 15 or 20) other bacterial strains from other genera with which it can live symbiotically in vivo in the intestine. For example, in some embodiments, the composition comprises a bacterial strain of *Enterococcus gallinarum* deposited under accession number NCIMB 42761, in combination with a bacterial strain from a different genus. In some embodiments, the microbial consortium comprises two or more bacterial strains obtained from a faeces sample of a single organism, e.g. a human. In some embodiments, the microbial consortium is not found together in nature. For example, in some embodiments, the microbial consortium comprises bacterial strains obtained from faeces samples of at least two different organisms. In some embodiments, the two different organisms are from the same species, e.g. two different humans, e.g. two different human infants. In some embodiments, the two different organisms are an infant human and an adult human. In some embodiments, the two different organisms are a human and a non-human mammal.

In some embodiments, the composition of the invention additionally comprises a bacterial strain that has the same safety and therapeutic efficacy characteristics as strain MRX554, but which is not MRX554 deposited as NCIMB 42761, or which is not an *Enterococcus gallinarum*.

In some embodiments in which the composition of the invention comprises more than one bacterial strain, species or genus, the individual bacterial strains, species or genera may be for separate, simultaneous or sequential administration. For example, the composition may comprise all of the more than one bacterial strain, species or genera, or the bacterial strains, species or genera may be stored separately and be administered separately, simultaneously or sequentially. In some embodiments, the more than one bacterial strains, species or genera are stored separately but are mixed together prior to use.

In some embodiments, the bacterial strain for use in the invention is obtained from human infant faeces. In some embodiments in which the composition of the invention comprises more than one bacterial strain, all of the bacterial strains are obtained from human infant faeces or if other bacterial strains are present they are present only in de minimis amounts. The bacteria may have been cultured subsequent to being obtained from the human infant faeces and being used in a composition of the invention.

As mentioned above, in some embodiments, the bacterial strain of *Enterococcus gallinarum* deposited under accession number NCIMB 42761, is the only therapeutically active agent in a composition of the invention. In some embodiments, the bacterial strain in the composition is the only therapeutically active agent in a composition of the invention.

The compositions for use in accordance with the invention may or may not require marketing approval.

In certain embodiments, the invention provides the above pharmaceutical composition, wherein said bacterial strain is lyophilised. In certain embodiments, the invention provides the above pharmaceutical composition, wherein said bacterial strain is spray dried. In certain embodiments, the invention provides the above pharmaceutical composition, wherein the bacterial strain is lyophilised or spray dried and wherein it is live. In certain embodiments, the invention provides the above pharmaceutical composition, wherein the bacterial strain is lyophilised or spray dried and wherein it is viable. In certain embodiments, the invention provides the above pharmaceutical composition, wherein the bacterial strain is lyophilised or spray dried and wherein it is capable of partially or totally colonising the intestine. In certain embodiments, the invention provides the above pharmaceutical composition, wherein the bacterial strain is lyophilised or spray dried and wherein it is viable and capable of partially or totally colonising the intestine.

In some cases, the lyophilised or spray dried bacterial strain is reconstituted prior to administration. In some cases, the reconstitution is by use of a diluent described herein.

The compositions of the invention can comprise pharmaceutically acceptable excipients, diluents or carriers.

In certain embodiments, the invention provides a pharmaceutical composition comprising: a bacterial strain as used in the invention; and a pharmaceutically acceptable excipient, carrier or diluent; wherein the bacterial strain is in an amount sufficient to treat a disorder when administered to a subject in need thereof; and wherein the disorder is breast cancer. In preferred embodiments the cancer is mammary carcinoma. In preferred embodiments the cancer is stage IV breast cancer.

In certain embodiments, the invention provides a pharmaceutical composition comprising: a bacterial strain as used in the invention; and a pharmaceutically acceptable excipient, carrier or diluent; wherein the bacterial strain is in an amount sufficient to treat a disorder when administered to a subject in need thereof; and wherein the disorder is lung cancer. In preferred embodiments the cancer is lung carcinoma.

In certain embodiments, the invention provides a pharmaceutical composition comprising: a bacterial strain as used in the invention; and a pharmaceutically acceptable excipient, carrier or diluent; wherein the bacterial strain is in an amount sufficient to treat a disorder when administered to a subject in need thereof; and wherein the disorder is liver cancer. In preferred embodiments the cancer is hepatoma (hepatocellular carcinoma).

In certain embodiments, the invention provides a pharmaceutical composition comprising: a bacterial strain of the invention; and a pharmaceutically acceptable excipient, carrier or diluent; wherein the bacterial strain is in an amount sufficient to treat a disorder when administered to a subject in need thereof; and wherein the disorder is colon cancer. In preferred embodiments the cancer is colorectal adenocarcinoma.

In certain embodiments, the invention provides a pharmaceutical composition comprising: a bacterial strain of the invention; and a pharmaceutically acceptable excipient, carrier or diluent; wherein the bacterial strain is in an amount sufficient to treat a disorder when administered to a subject in need thereof; and wherein the disorder is carcinoma.

In certain embodiments, the invention provides a pharmaceutical composition comprising: a bacterial strain of the invention; and a pharmaceutically acceptable excipient, carrier or diluent; wherein the bacterial strain is in an amount sufficient to treat a disorder when administered to a subject in need thereof; and wherein the disorder is a non-immunogenic cancer.

In certain embodiments, the invention provides a pharmaceutical composition comprising: a bacterial strain of the invention; and a pharmaceutically acceptable excipient, carrier or diluent; wherein the bacterial strain is in an amount sufficient to treat a disorder when administered to a subject in need thereof; and wherein the disorder is selected from the group consisting of non-small-cell lung carcinoma, small-cell lung carcinoma, squamous-cell carcinoma, adenocarcinoma, glandular tumors, carcinoid tumors undifferentiated carcinomas.

In certain embodiments, the invention provides a pharmaceutical composition comprising: a bacterial strain of the invention; and a pharmaceutically acceptable excipient, carrier or diluent; wherein the bacterial strain is in an amount sufficient to treat a disorder when administered to a subject in need thereof; and wherein the disorder is selected from the group consisting of hepatoblastoma, cholangiocarcinoma, cholangiocellular cystadenocarcinoma or liver cancer resulting from a viral infection.

In certain embodiments, the invention provides a pharmaceutical composition comprising: a bacterial strain of the invention; and a pharmaceutically acceptable excipient, carrier or diluent; wherein the bacterial strain is in an amount sufficient to treat a disorder when administered to a subject in need thereof; and wherein the disorder is selected from the group consisting of invasive ductal carcinoma, ductal carcinoma in situ or invasive lobular carcinoma.

In certain embodiments, the invention provides a pharmaceutical composition comprising: a bacterial strain of the invention; and a pharmaceutically acceptable excipient, carrier or diluent; wherein the bacterial strain is in an amount sufficient to treat a disorder when administered to a subject in need thereof; and wherein the disorder is selected from the group consisting of acute lymphoblastic leukemia (ALL), acute myeloid leukemia, adrenocortical carcinoma, basal-cell carcinoma, bile duct cancer, bladder cancer, bone tumor, osteosarcoma/malignant fibrous histiocytoma, brainstem glioma, brain tumor, cerebellar astrocytoma, cerebral astrocytoma/malignant glioma, ependymoma, medulloblastoma, supratentorial primitive neuroectodermal tumors, breast cancer, bronchial adenomas/carcinoids, Burkitt's lymphoma, carcinoid tumor, cervical cancer, chronic lymphocytic leukemia, chronic myelogenous leukemia, chronic myeloproliferative disorders, colon cancer, cutaneous T-cell lymphoma, endometrial cancer, ependymoma, esophageal cancer, Ewing's sarcoma, intraocular melanoma, retinoblastoma, gallbladder cancer, gastric cancer, gastrointestinal carcinoid tumor, gastrointestinal stromal tumor (GIST), germ cell tumor, glioma, childhood visual pathway and hypothalamic, Hodgkin lymphoma, melanoma, islet cell carcinoma, Kaposi sarcoma, renal cell cancer, laryngeal cancer, leukaemias, lymphomas, mesothelioma, neuroblastoma, non-Hodgkin lymphoma, oropharyngeal cancer, osteosarcoma, ovarian cancer, pancreatic cancer, parathyroid cancer, pharyngeal cancer, pituitary adenoma, plasma cell neoplasia, prostate cancer, renal cell carcinoma, retinoblastoma, sarcoma, testicular cancer, thyroid cancer, or uterine cancer.

In certain embodiments, the invention provides the above pharmaceutical composition, wherein the amount of the bacterial strain is from about $1 \times 10^3$ to about $1 \times 10^{11}$ colony forming units per gram with respect to a weight of the composition.

In certain embodiments, the invention provides the above pharmaceutical composition, wherein the composition is administered at a dose of 1 g, 3 g, 5 g or 10 g.

In certain embodiments, the invention provides the above pharmaceutical composition, wherein the composition is administered by a method selected from the group consisting of oral, rectal, subcutaneous, nasal, buccal, and sublingual.

In certain embodiments, the invention provides the above pharmaceutical composition, comprising a carrier selected from the group consisting of lactose, starch, glucose, methyl cellulose, magnesium stearate, mannitol and sorbitol.

In certain embodiments, the invention provides the above pharmaceutical composition, comprising a diluent selected from the group consisting of ethanol, glycerol and water.

In certain embodiments, the invention provides the above pharmaceutical composition, comprising an excipient selected from the group consisting of starch, gelatin, glucose, anhydrous lactose, free-flow lactose, beta-lactose, corn sweetener, acacia, tragacanth, sodium alginate, carboxymethyl cellulose, polyethylene glycol, sodium oleate, sodium stearate, magnesium stearate, sodium benzoate, sodium acetate and sodium chloride.

In certain embodiments, the invention provides the above pharmaceutical composition, further comprising at least one of a preservative, an antioxidant and a stabilizer.

In certain embodiments, the invention provides the above pharmaceutical composition, comprising a preservative selected from the group consisting of sodium benzoate, sorbic acid and esters of p-hydroxybenzoic acid.

In certain embodiments, the invention provides the above pharmaceutical composition, wherein when the composition is stored in a sealed container at about 4° C. or about 25° C. and the container is placed in an atmosphere having 50% relative humidity, at least 80% of the bacterial strain as measured in colony forming units, remains after a period of at least about: 1 month, 3 months, 6 months, 1 year, 1.5 years, 2 years, 2.5 years or 3 years.

In some embodiments, the composition of the invention is provided in a sealed container comprising a composition as described herein. In some embodiments, the sealed container is a sachet or bottle. In some embodiments, the composition of the invention is provided in a syringe comprising a composition as described herein.

The composition of the present invention may, in some embodiments, be provided as a pharmaceutical formulation. For example, the composition may be provided as a tablet or capsule. In some embodiments, the capsule is a gelatine capsule ("gel-cap").

In some embodiments, the compositions of the invention are administered orally. Oral administration may involve swallowing, so that the compound enters the gastrointestinal tract, and/or buccal, lingual, or sublingual administration by which the compound enters the blood stream directly from the mouth.

Pharmaceutical formulations suitable for oral administration include solid plugs, solid microparticulates, semi-solid and liquid (including multiple phases or dispersed systems) such as tablets; soft or hard capsules containing multi- or nano-particulates, liquids (e.g. aqueous solutions), emulsions or powders; lozenges (including liquid-filled); chews; gels; fast dispersing dosage forms; films; ovules; sprays; and buccal/mucoadhesive patches.

In some embodiments the pharmaceutical formulation is an enteric formulation, i.e. a gastro-resistant formulation (for example, resistant to gastric pH) that is suitable for delivery of the composition of the invention to the intestine by oral administration. Enteric formulations may be particularly useful when the bacteria or another component of the composition is acid-sensitive, e.g. prone to degradation under gastric conditions.

In some embodiments, the enteric formulation comprises an enteric coating. In some embodiments, the formulation is an enteric-coated dosage form. For example, the formulation may be an enteric-coated tablet or an enteric-coated capsule, or the like. The enteric coating may be a conventional enteric coating, for example, a conventional coating for a tablet, capsule, or the like for oral delivery. The formulation may comprise a film coating, for example, a thin film layer of an enteric polymer, e.g. an acid-insoluble polymer.

In some embodiments, the enteric formulation is intrinsically enteric, for example, gastro-resistant without the need for an enteric coating. Thus, in some embodiments, the formulation is an enteric formulation that does not comprise an enteric coating. In some embodiments, the formulation is a capsule made from a thermogelling material. In some embodiments, the thermogelling material is a cellulosic material, such as methylcellulose, hydroxymethylcellulose or hydroxypropylmethylcellulose (HPMC). In some embodiments, the capsule comprises a shell that does not contain any film forming polymer. In some embodiments, the capsule comprises a shell and the shell comprises hydroxypropylmethylcellulose and does not comprise any film forming polymer (e.g. see [33]). In some embodiments, the formulation is an intrinsically enteric capsule (for example, Vcaps® from Capsugel).

In some embodiments, the formulation is a soft capsule. Soft capsules are capsules which may, owing to additions of softeners, such as, for example, glycerol, sorbitol, maltitol and polyethylene glycols, present in the capsule shell, have a certain elasticity and softness. Soft capsules can be produced, for example, on the basis of gelatine or starch. Gelatine-based soft capsules are commercially available from various suppliers. Depending on the method of administration, such as, for example, orally or rectally, soft capsules can have various shapes, they can be, for example, round, oval, oblong or torpedo-shaped. Soft capsules can be produced by conventional processes, such as, for example, by the Scherer process, the Accogel process or the droplet or blowing process.

Culturing Methods

The bacterial strain for use in the present invention can be cultured using standard microbiology techniques as detailed in, for example, references [34-36].

The solid or liquid medium used for culture may be YCFA agar or YCFA medium. YCFA medium may include (per 100 ml, approximate values): Casitone (1.0 g), yeast extract (0.25 g), $NaHCO_3$ (0.4 g), cysteine (0.1 g), $K_2HPO_4$ (0.045 g), $KH_2PO_4$ (0.045 g), NaCl (0.09 g), $(NH_4)_2SO_4$ (0.09 g), $MgSO_4.7H_2O$ (0.009 g), $CaCl_2$ (0.009 g), resazurin (0.1 mg), hemin (1 mg), biotin (1 µg), cobalamin (1 µg), p-aminobenzoic acid (3 µg), folic acid (5 µg), and pyridoxamine (15 µg).

Bacterial Strain for Use in Vaccine Compositions

The inventors have identified that the bacterial strain of the invention is useful for treating or preventing cancer. This is likely to be a result of the effect that the bacterial strain of the invention have on the host immune system. Therefore, the compositions of the invention may also be useful for preventing cancer, when administered as vaccine compositions. In certain such embodiments, the bacterial strain of the invention is viable. In certain such embodiments, the bacterial strain of the invention is capable of partially or totally colonising the intestine. In certain such embodiments, the bacterial strain of the invention is viable and capable of partially or totally colonising the intestine. In other certain such embodiments, the bacterial strain of the invention may be killed, inactivated or attenuated. In certain such embodiments, the compositions may comprise a vaccine adjuvant. In certain embodiments, the compositions are for administration via injection, such as via subcutaneous injection.

General

The practice of the present invention will employ, unless otherwise indicated, conventional methods of chemistry, biochemistry, molecular biology, immunology and pharmacology, within the skill of the art. Such techniques are explained fully in the literature. See, e.g., references [37] and [38-44], etc.

The term "comprising" encompasses "including" as well as "consisting" e.g. a composition "comprising" X may consist exclusively of X or may include something additional e.g. X+Y.

The term "about" in relation to a numerical value x is optional and means, for example, x±10%.

The word "substantially" does not exclude "completely" e.g. a composition which is "substantially free" from Y may be completely free from Y. Where necessary, the word "substantially" may be omitted from the definition of the invention.

References to a percentage sequence identity between two nucleotide sequences means that, when aligned, that percentage of nucleotides are the same in comparing the two sequences. This alignment and the percent homology or sequence identity can be determined using software programs known in the art, for example those described in section 7.7.18 of ref. [45]. A preferred alignment is determined by the Smith-Waterman homology search algorithm using an affine gap search with a gap open penalty of 12 and a gap extension penalty of 2, BLOSUM matrix of 62. The Smith-Waterman homology search algorithm is disclosed in ref [46].

Unless specifically stated, a process or method comprising numerous steps may comprise additional steps at the beginning or end of the method, or may comprise additional intervening steps. Also, steps may be combined, omitted or performed in an alternative order, if appropriate.

Various embodiments of the invention are described herein. It will be appreciated that the features specified in each embodiment may be combined with other specified features, to provide further embodiments. In particular, embodiments highlighted herein as being suitable, typical or preferred may be combined with each other (except when they are mutually exclusive).

MODES FOR CARRYING OUT THE INVENTION

Example 1—Efficacy of Bacterial Inocula in Mouse Models of Cancer

Summary

This study tested the efficacy of compositions comprising bacterial strain according to the invention in a tumor model.

Materials

Test substance—Bacterial strain #MRX554.
Reference substance—Anti-CTLA-4 antibody (clone: 9H10, catalog: BE0131, isotype: Syrian Hamster IgG1, Bioxcell).
Test and reference substances vehicles—Bacterial culture medium (Yeast extract, Casitone, Fatty Acid medium (YCFA)). Each day of injection to mice, antibody was diluted with PBS (ref: BE14-516F, Lonza, France).
Treatment doses—Bacteria: $2\times10^8$ in 200 µL YCFA. The a-CTLA-4 was injected at 10 mg/kg/inj. Anti-CTLA-4 was administered at a dose volume of 10 mL/kg/adm (i.e. for one mouse weighing 20 g, 200 µL of test substance will be administered) according to the most recent body weight of mice.

Routes of administration—Bacterial inoculum was administered by oral gavage (per os, PO) via a cannula. Cannulas were decontaminated every day. Anti-CTLA-4 was injected into the peritoneal cavity of mice (Intraperitoneally, IP).

Culture conditions of bacterial strain—The culture conditions for the bacterial strain were as follows:
- Pipette 10 mL of YCFA (from the prepared 10 mL E&O lab bottles) into Hungate tubes
- Seal the tubes and flush with $CO_2$ using a syringe input and exhaust system
- Autoclave the Hungate tubes
- When cooled, inoculate the Hungate tubes with 1 mL of the glycerol stocks
- Place the tubes in a static 37° C. incubator for about 16 hours.
- The following day, take 1 mL of this subculture and inoculate 10 mL of YCFA (pre-warmed flushed Hungate tubes again, all in duplicate)
- Place them in a static 37° C. incubator for 5 to 6 h Cancer Cell Line and Culture Conditions—

The cell lines that were used are detailed in the table below:

| Cell line | Type | Mouse strain | Origin |
| --- | --- | --- | --- |
| EMT-6 | Breast carcinoma | BALB/c | ATCC |

The EMT-6 cell line was established from a transplantable murine mammary carcinoma that arose in a BALB/cCRGL mouse after implantation of a hyperplastic mammary alveolar nodule [47].

Cell culture conditions—All cell lines were grown as monolayer at 37° C. in a humidified atmosphere (5% $CO_2$, 95% air). The culture medium and supplement are indicated in the table below:

| Cell line | Culture medium | Supplement |
| --- | --- | --- |
| EMT6 | RPMI 1640 containing 2 mM L-glutamine (ref: BE12-702F, Lonza) | 10% fetal bovine serum (ref: #3302, Lonza) |

For experimental use, adherent tumor cells were detached from the culture flask by a 5 minute treatment with trypsin-versene (ref: BE17-161E, Lonza), in Hanks' medium without calcium or magnesium (ref: BE10-543F, Lonza) and neutralized by addition of complete culture medium. The cells were counted in a hemocytometer and their viability will be assessed by 0.25% trypan blue exclusion assay.

Use of Animals—

Healthy female Balb/C (BALB/cByJ) mice, of matching weight and age, were obtained from CHARLES RIVER (L'Arbresles) for the EMT6 model experiments.

Animals were maintained in SPF health status according to the FELASA guidelines, and animal housing and experimental procedures according to the French and European Regulations and NRC Guide for the Care and Use of Laboratory Animals were followed [48,49]. Animals were maintained in housing rooms under controlled environmental conditions: Temperature: 22±2° C., Humidity 55±10%, Photoperiod (12 h light/12 h dark), HEPA filtered air, 15 air exchanges per hour with no recirculation. Animal enclosures were provided with sterile and adequate space with bedding material, food and water, environmental and social enrichment (group housing) as described: 900 $cm^2$ cages (ref: green, Tecniplast) in ventilated racks, Epicea bedding (SAFE),10 kGy Irradiated diet (A04-10, SAFE), Complete food for immuno-competent rodents—R/M-H Extrudate, water from water bottles.

Experimental Design and Treatments

Antitumor Activity, EMT6 Model

Treatment schedule—The start of first dosing was considered as D0. On D0, non-engrafted mice were randomized according to their individual body weight into groups of 9/8 using Vivo Manager® software (Biosystemes, Couternon, France). On D0, the mice received vehicle (culture medium) or bacterial strain. On D14, all mice were engrafted with EMT-6 tumor cells as described below. On D24, mice from the positive control group received anti-CTLA-4 antibody treatments.

The treatment schedule is summarized in the table below:

| Group | No. Animals | Treatment | Dose | Route | Treatment Schedule |
| --- | --- | --- | --- | --- | --- |
| 1 | 8 | Untreated | — | — | — |
| 2 | 8 | Vehicle (media) | — | PO | 38 days EMT6 |
| 3 | 8 | MR × 0554 | $2 \times 10^8$ bacteria | PO | 38 days EMT6 |
| 4 | 8 | Anti-CTLA4 | 10 mg/kg | IP | TW × 2, D10, D13, D17 and D20 for EMT6 |

The monitoring of animals was performed as described below.

Induction of EMT6 tumors in animals—On D14, tumors were induced by subcutaneous injection of $1 \times 10^6$ EMT-6 cells in 200 µL RPMI 1640 into the right flank of mice.

Euthanasia—Each mouse was euthanized when it reached a humane endpoint as described below, or after a maximum of 6 weeks post start of dosing.

Animal Monitoring

Clinical monitoring—The length and width of the tumor was measured twice a week with callipers and the volume of the tumor was estimated by this formula [50]:

$$\text{Tumor volume} = \frac{\text{width}^2 \times \text{length}}{2}$$

Humane endpoints [51]: Signs of pain, suffering or distress: pain posture, pain face mask, behaviour; Tumor exceeding 10% of normal body weight, but non-exceeding 2000 $mm^3$; Tumors interfering with ambulation or nutrition; Ulcerated tumor or tissue erosion; 20% body weight loss remaining for 3 consecutive days; Poor body condition, emaciation, cachexia, dehydration; Prolonged absence of voluntary responses to external stimuli; Rapid laboured breathing, anaemia, significant bleeding; Neurologic signs: circling, convulsion, paralysis; Sustained decrease in body temperature; Abdominal distension.

Anaesthesia—Isoflurane gas anesthesia were used for all procedures: surgery or tumor inoculation, i.v. injections, blood collection. Ketamine and Xylazine anesthesia were used for stereotaxia surgical procedure.

Analgesia—Carprofen or multimodal carprofen/buprenorphine analgesia protocol were adapted to the severity of surgical procedure. Non-pharmacological care was provided for all painful procedures. Additionally, pharmacological care not interfering with studies (topic treatment) were provided at the recommendation of the attending veterinarian.

Euthanasia—Euthanasia of animals was performed by gas anesthesia over-dosage (Isoflurane) followed by cervical dislocation or exsanguination.

Results

Antitumor Activity, EMT6 Model

The results are shown in FIG. 1. Treatment with the bacterial strain of the invention led to a clear reduction in tumour volume relative to both the negative controls. The positive control also led to a reduction in tumour volume, as would be expected.

These data indicate that strain MRX554 may be useful for treating or preventing cancer, and in particular for reducing tumour volume in breast cancer.

Example 2—Stability Testing

A composition described herein containing the bacterial strain described herein is stored in a sealed container at 25° C. or 4° C. and the container is placed in an atmosphere having 30%, 40%, 50%, 60%, 70%, 75%, 80%, 90% or 95% relative humidity. After 1 month, 2 months, 3 months, 6 months, 1 year, 1.5 years, 2 years, 2.5 years or 3 years, at least 50%, 60%, 70%, 80% or 90% of the bacterial strain shall remain as measured in colony forming units determined by standard protocols.

Example 3—Analysis of Carbohydrate Metabolism—API 50 CHL Analysis of MRX0554

The Analytical Profile Index (API) test system consists of strips which contain miniaturised biochemical tests which assay for enzymatic activity in bacterial species. These tests are routinely used in the characterisation of novel strains. API 50 CHL testing was carried out to examine carbohydrate metabolism in MRx0554. As per manufacturer's instructions, bacteria were cultured in 10 ml YCFA broth for 16-18 hours at 37° C. in an anaerobic workstation. This culture was diluted in 10 ml API CHL Medium so as to achieve a density roughly equivalent to McFarland standard No. 2, and 110 µl of this mixture was used to inoculate each cupule on a set of API 50 CH test strips. Test strips were incubated in a humidified incubation box at 37° C. in an anaerobic workstation for 48 hours, following which the colour of each cupule was recorded and assigned a value of negative, intermediate positive, positive or doubtful.

Figure 2:
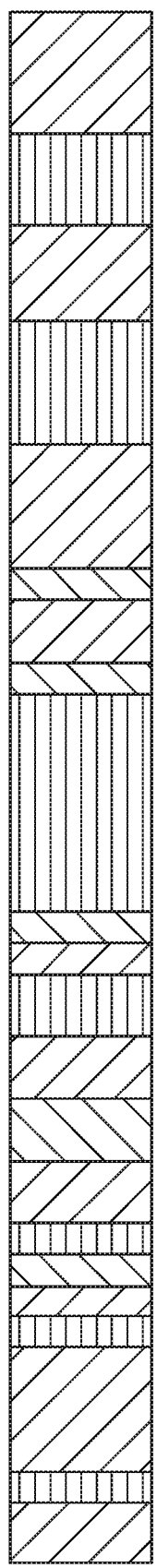
FIG. 2: API 50 CHL profile of MRx0554.

Using API 50 CHL analysis, MRx0554 tested positive for fermentation of L-arabinose, D-ribose, D-xylose, D-galactose, D-glucose, D-fructose, D-mannose, N-acetylglucosamine, amygdalin, arbutin, esculin, salicin, D-cellobiose, D-maltose, D-saccharose (sucrose), D-trehalose, gentiobiose, D-tagatose, and potassium gluconate (FIG. 2). Intermediate reactions were observed for D-mannitol, methyl α-D-glucopyranoside, D-lactose, D-raffinose, amidon (starch), and D-turanose.

```
SEQUENCES
(Enterococcus gallinarum 16S rRNA gene-AF039900)
                                                                SEQ ID NO: 1
   1 taatacatgc aagtcgaacg cttttctttt caccggagct tgctccaccg aaagaaaaag 61 agtggcgaac gggtgagtaa cacgtgggta acctgcccat cagaagggga taacacttgg 121 aaacaggtgc taataccgta taacactatt ttccgcatgg aagaaagttg aaaggcgctt 181 ttgcgtcact gatggatgga cccgcggtgc attagctagt tggtgaggta acggctcacc 241 aaggccacga tgcatagccg acctgagagg gtgatcggcc acactgggac tgagacacgg 301 cccagactcc tacgggaggc agcagtaggg aatcttcggc aatggacgaa agtctgaccg 361 agcaacgccg cgtgagtgaa gaaggttttc ggatcgtaaa actctgttgt tagagaagaa 421 caaggatgag agtagaacgt tcatcccttg acggtatcta accagaaagc cacggctaac 481 tacgtgccag cagccgcggt aatacgtagg tggcaagcgt tgtccggatt tattgggcgt 541 aaagcgagcg caggcggttt cttaagtctg atgtgaaagc cccggctca accggggagg 601 gtcattggaa actgggagac ttgagtgcag aagaggagag tggaattcca tgtgtagcgg 661 tgaaatgcgt agatatatgg aggaacacca gtggcgaagg cggctctctg gtctgtaact 721 gacgctgagg ctcgaaagcg tggggagcga acaggattag ataccctggt agtccacgcc 781 gtaaacgatg agtgctaagt gttgagggt ttccgccctt cagtgctgca gcaaacgcat 841 taagcactcc gcctggggag tacgaccgca aggttgaaac tcaaaggaat tgacggggc 901 ccgcacaagc ggtggagcat gtggtttaat tcgaagcaac gcgaagaacc ttaccaggtc
```

-continued

```
 961 ttgacatcct tgaccactc tagagataga gcttcccctt cggggggcaaa gtgacaggtg 1021 gtgcatggtt gtcgtcagct cgtgtcgtga gatgttgggt taagtcccgc aacgagcgca 1081 acccttattg ttagttgcca tcatttagtt gggcactcta gcgagactgc cggtgacaaa 1141 ccggaggaag gtggggatga cgtcaaatca tcatgcccct tatgacctgg gctacacacg 1201 tgctacaatg gaagtacaa cgagttgcga agtcgcgagg ctaagctaat ctcttaaagc 1261 ttctctcagt tcggattgta ggctgcaact cgcctacatg aagccggaat cgctagtaat 1321 cgcggatcag cacgccgcgg tgaatacgtt cccgggcctt gtacacaccg cccgtcacac 1381 cacgagagtt tgtaacaccc gaagtcggtg aggtaacctt tttggagcca gccgcctaag 1441 gtgggataga tgattggggt gaagtcgtaa caaggtagcc gtatcggaag gtgcggctgg 1501 atcacc
```

SEQ ID NO: 2-see electronic sequence listing. Strain MRX554 genome sequence. Ns in the sequence represent gaps between contigs.

(16S rRNA gene for *Enterococcus gallinarum* strain MRX554)

SEQ ID NO: 3

```
   1 taatacatgc aagtcgaacg ctttttcttt caccggagct tgctccaccg aaagaaaaag 61 agtggcgaac gggtgagtaa cacgtgggta acctgcccat cagaagggga taacacttgg 121 aaacaggtgc taataccgta taacactatt ttccgcatgg aagaaagttg aaaggcgctt 181 ttgcgtcact gatggatgga cccgcggtgc attagctagt tggtgaggta acggctcacc 241 aaggccacga tgcatagccg acctgagagg gtgatcggcc acactgggac tgagacacgg 301 cccagactcc tacgggaggc agcagtaggg aatcttcggc aatggacgaa agtctgaccg 361 agcaacgccg cgtgagtgaa gaaggttttc ggatcgtaaa actctgttgt tagagaagaa 421 caaggatgag agtagaacgt tcatcccttg acggtatcta accagaaagc cacggctaac 481 tacgtgccag cagccgcggt aatacgtagg tggcaagcgt tgtccggatt tattgggcgt 541 aaagcgagcg caggcggttt cttaagtctg atgtgaaagc ccccggctca accggggagg 601 gtcattggaa actgggagac ttgagtgcag aagaggagag tggaattcca tgtgtagcgg 661 tgaaatgcgt agatatatgg aggaacacca gtggcgaagg cggctctctg gtctgtaact 721 gacgctgagg ctcgaaagcg tggggagcga acaggattag ataccctggt agtccacgcc 781 gtaaacgatg agtgctaagt gttggagggt ttccgccctt cagtgctgca gcaaacgcat 841 taagcactcc gcctggggag tacgaccgca aggttgaaac tcaaaggaat tgacggggc 901 ccgcacaagc ggtggagcat gtggtttaat tcgaagcaac gcgaagaacc ttaccaggtc 961 ttgacatcct tgaccactc tagagataga gcttcccctt cggggggcaaa gtgacaggtg 1021 gtgcatggtt gtcgtcagct cgtgtcgtga gatgttgggt taagtcccgc aacgagcgca 1081 acccttattg ttagttgcca tcatttagtt gggcactcta gcgagactgc cggtgacaaa 1141 ccggaggaag gtggggatga cgtcaaatca tcatgcccct tatgacctgg gctacacacg 1201 tgctacaatg gaagtacaa cgagttgcga agtcgcgagg ctaagctaat ctcttaaagc 1261 ttctctcagt tcggattgta ggctgcaact cgcctacatg aagccggaat cgctagtaat 1321 cgcggatcag cacgccgcgg tgaatacgtt cccgggcctt gtacacaccg cccgtcacac 1381 cacgagagtt tgtaacaccc gaagtcggtg aggtaacctt tttggagcca gccgcctaag 1441 gtgggataga tgattggggt gaagtcgtaa caaggtagcc gtatcggaag gtgcggctgg 1501 atcacc
```

REFERENCES

[1] Spor et al. (2011) *Nat Rev Microbiol.* 9(4):279-90.
[2] Eckburg et al. (2005) *Science.* 10; 308(5728):1635-8.
[3] Macpherson et al. (2001) *Microbes Infect.* 3(12):1021-35
[4] Macpherson et al. (2002) *Cell Mol Life Sci.* 59(12):2088-96.
[5] Mazmanian et al. (2005) *Cell* 15; 122(1):107-18.
[6] Frank et al. (2007) *PNAS* 104(34):13780-5.
[7] Scanlan et al. (2006) *J Clin Microbiol.* 44(11):3980-8.
[8] Kang et al. (2010) *Inflamm Bowel Dis.* 16(12):2034-42.
[9] Machiels et al. (2013) *Gut.* 63(8):1275-83.
[10] WO 2013/050792
[11] WO 03/046580
[12] WO 2013/008039
[13] WO 2014/167338
[14] Goldin and Gorbach (2008) *Clin Infect Dis.* 46 Suppl 2:S96-100.
[15] Azad et al. (2013) *BMJ.* 347:f6471.
[16] Strickertsson et al. (2014) *Genes.* 5(3): 726-738.
[17] Collins et al. (1984) *Int J Syst Evol Microbiol.* 34: 220-223.
[18] Masco et al. (2003) *Systematic and Applied Microbiology,* 26:557-563.
[19] Srůtková et al. (2011) *J. Microbiol. Methods,* 87(1):10-6.
[20] Haabeth et al. (2012) *OncoImmunology* 1(1):1146-1152.
[21] Lejeune et al. (2006) *Cancer Immun.* 6:6
[22] Pace et al. (1983) *PNAS.* 80:8782-6.
[23] Sgadari et al. (1996) *PNAS.* 93:13791-6.
[24] Arenberg et al. (1996) *J. Exp. Med.* 184:981-92.
[25] Sgadari et al. (1997) *Blood.* 89:2635-43.
[26] Miyamoto-Shinohara et al. (2008) *J. Gen. Appl. Microbiol.,* 54, 9-24.
[27] Cryopreservation and Freeze-Drying Protocols, ed. by Day and McLellan, Humana Press.
[28] Leslie et al. (1995) *Appl. Environ. Microbiol.* 61, 3592-3597.
[29] Mitropoulou et al. (2013) *J Nutr Metab.* (2013) 716861.
[30] Kailasapathy et al. (2002) *Curr Issues Intest Microbiol.* 3(2):39-48.
[31] Handbook of Pharmaceutical Excipients, 2nd Edition, (1994), Edited by A Wade and P J Weller
[32] Remington's Pharmaceutical Sciences, Mack Publishing Co. (A. R. Gennaro edit. 1985)
[33] US 2016/0067188
[34] Handbook of Microbiological *Media, Fourth Edition* (2010) Ronald Atlas, CRC Press.
[35] *Maintaining Cultures for Biotechnology and Industry* (1996) Jennie C. Hunter-Cevera, Academic Press
[36] Strobel (2009) *Methods Mol Biol.* 581:247-61.
[37] Gennaro (2000) *Remington: The Science and Practice of Pharmacy.* 20th edition, ISBN: 0683306472.
[38] *Molecular Biology Techniques: An Intensive Laboratory Course,* (Ream et al., eds., 1998, Academic Press).
[39] *Methods In Enzymology* (S. Colowick and N. Kaplan, eds., Academic Press, Inc.)
[40] *Handbook of Experimental Immunology,* Vols. I-IV (D. M. Weir and C. C. Blackwell, eds, 1986, Blackwell Scientific Publications)
[41] Sambrook et al. (2001) *Molecular Cloning: A Laboratory Manual,* 3rd edition (Cold Spring Harbor Laboratory Press).
[42] *Handbook of Surface and Colloidal Chemistry* (Birdi, K. S. ed., CRC Press, 1997)
[43] Ausubel et al. (eds) (2002) *Short protocols in molecular biology,* 5th edition (Current Protocols).
[44] *PCR (Introduction to Biotechniques Series),* 2nd ed. (Newton & Graham eds., 1997, Springer Verlag)
[45] *Current Protocols in Molecular Biology* (F. M. Ausubel et al., eds., 1987) Supplement 30
[46] Smith & Waterman (1981) *Adv. Appl. Math.* 2: 482-489.
[47] Rockwell et al., (1972) *J Natl Cancer Inst.* 49:735-49.
[48] Principe d'éthique de l'expérimentation animale, Directive no 2010/63 CEE 22 Sep. 2010, Décrêt no 2013-118 1 Feb. 2013.
[49] Guide for the Care and Use of Laboratory Animals: Eighth Edition. The National Academies Press; 2011
[50] Simpson-Herren and Lloyd (1970) *Cancer Chemother Rep.* 54:143-74.
[51] Workman et al. (2010) *Br. J. Cancer.* 102:1555-77.

SEQUENCE LISTING (3 sequences)

SEQ ID NO: 1 - DNA, 1506 bp, Enterococcus gallinarum
taatacatgcaagtcgaacgctttttctttcaccggagcttgctccaccgaaagaaaaagagtggcgaacgggtgagtaacacgtgggtaacctgcccatcagaaggggataacacttggaaacaggtgctaataccgtataacactattttccgcatggaagaaagttgaaaggcgcttttgcgtcactgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtagaacgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacc

SEQ ID NO: 2 - DNA, 3458289 bp, Enterococcus gallinarum (residues 1-1,729,145 of 3,458,289)
  modified_base (1)..(24): a, c, t, or g
  modified_base (142973)..(142981): a, c, t, or g
  modified_base (220260)..(220262): a, c, t, or g
  modified_base (267996)..(268005): a, c, t, or g
  modified_base (559463)..(559470): a, c, t, or g
  modified_base (736143)..(736143): a, c, t, or g
  modified_base (909086)..(909089): a, c, t, or g
  modified_base (1118319)..(1118329): a, c, t, or g
  modified_base (1285898)..(1285913): a, c, t, or g
  modified_base (1570949)..(1570949): a, c, t, or g
  modified_base (1664650)..(1664661): a, c, t, or g
  modified_base (1665322)..(1665343): a, c, t, or g
  modified_base (2316792)..(2316831): a, c, t, or g
  modified_base (2379761)..(2379763): a, c, t, or g
  modified_base (2504871)..(2504882): a, c, t, or g
  modified_base (2675546)..(2675549): a, c, t, or g
  modified_base (2788147)..(2788175): a, c, t, or g
  modified_base (2856264)..(2856356): a, c, t, or g
  modified_base (2871838)..(2871930): a, c, t, or g
  modified_base (2944459)..(2944491): a, c, t, or g
  modified_base (3028740)..(3028743): a, c, t, or g
  modified_base (3069181)..(3069182): a, c, t, or g
  modified_base (3109254)..(3109260): a, c, t, or g
  modified_base (3110866)..(3110933): a, c, t, or g
  modified_base (3141279)..(3141280): a, c, t, or g
  modified_base (3142219)..(3142285): a, c, t, or g
  modified_base (3146907)..(3146992): a, c, t, or g
  modified_base (3147524)..(3147557): a, c, t, or g
  modified_base (3148076)..(3148094): a, c, t, or g
  modified_base (3149544)..(3149723): a, c, t, or g
  modified_base (3151476)..(3151500): a, c, t, or g
  modified_base (3165480)..(3165495): a, c, t, or g
  modified_base (3165969)..(3166019): a, c, t, or g
  modified_base (3167873)..(3168031): a, c, t, or g
  modified_base (3168407)..(3168411): a, c, t, or g
  modified_base (3169298)..(3169370): a, c, t, or g
  modified_base (3170441)..(3170471): a, c, t, or g
  modified_base (3170806)..(3170817): a, c, t, or g
  modified_base (3171306)..(3171336): a, c, t, or g
  modified_base (3171735)..(3171828): a, c, t, or g
  modified_base (3172757)..(3172899): a, c, t, or g
  modified_base (3173562)..(3173592): a, c, t, or g
  modified_base (3173984)..(3174256): a, c, t, or g
  modified_base (3174579)..(3175462): a, c, t, or g
  modified_base (3175674)..(3176023): a, c, t, or g
  modified_base (3176308)..(3177510): a, c, t, or g
  modified_base (3177722)..(3179914): a, c, t, or g
  modified_base (3180215)..(3180319): a, c, t, or g
  modified_base (3180382)..(3180974): a, c, t, or g
  modified_base (3181034)..(3181079): a, c, t, or g
  modified_base (3181102)..(3181320): a, c, t, or g
  modified_base (3181851)..(3184112): a, c, t, or g
  modified_base (3184433)..(3184625): a, c, t, or g
  modified_base (3184972)..(3185410): a, c, t, or g
  modified_base (3185706)..(3185820): a, c, t, or g
  modified_base (3186134)..(3187333): a, c, t, or g
  modified_base (3187502)..(3188663): a, c, t, or g
  modified_base (3188835)..(3193388): a, c, t, or g
  modified_base (3193633)..(3196510): a, c, t, or g
  modified_base (3196609)..(3197829): a, c, t, or g
  modified_base (3198039)..(3198614): a, c, t, or g
  modified_base (3198832)..(3199931): a, c, t, or g
  modified_base (3200254)..(3200566): a, c, t, or g
  modified_base (3200847)..(3203183): a, c, t, or g
  modified_base (3203375)..(3207398): a, c, t, or g
  modified_base (3207438)..(3207528): a, c, t, or g
  modified_base (3207706)..(3211833): a, c, t, or g
  modified_base (3211969)..(3212092): a, c, t, or g
  modified_base (3212284)..(3212582): a, c, t, or g
  modified_base (3212734)..(3212773): a, c, t, or g
  modified_base (3213018)..(3214053): a, c, t, or g
  modified_base (3214222)..(3214271): a, c, t, or g
  modified_base (3214541)..(3214960): a, c, t, or g
  modified_base (3215267)..(3215472): a, c, t, or g
  modified_base (3215726)..(3216587): a, c, t, or g
  modified_base (3216785)..(3218296): a, c, t, or g
  modified_base (3218530)..(3218760): a, c, t, or g
  modified_base (3219012)..(3219795): a, c, t, or g
  modified_base (3220050)..(3221090): a, c, t, or g
  modified_base (3221322)..(3223894): a, c, t, or g
  modified_base (3224161)..(3230520): a, c, t, or g
  modified_base (3230813)..(3232601): a, c, t, or g
  modified_base (3232909)..(3233419): a, c, t, or g
  modified_base (3233611)..(3234786): a, c, t, or g
  modified_base (3235088)..(3235673): a, c, t, or g
  modified_base (3235824)..(3237674): a, c, t, or g
  modified_base (3237831)..(3241512): a, c, t, or g
  modified_base (3241699)..(3242995): a, c, t, or g
  modified_base (3243144)..(3243189): a, c, t, or g
  modified_base (3243397)..(3247317): a, c, t, or g
  modified_base (3247453)..(3248161): a, c, t, or g
  modified_base (3248328)..(3251400): a, c, t, or g
  modified_base (3251414)..(3251420): a, c, t, or g
  modified_base (3251594)..(3256219): a, c, t, or g
  modified_base (3256392)..(3257317): a, c, t, or g
  modified_base (3257631)..(3258550): a, c, t, or g
  modified_base (3258838)..(3259781): a, c, t, or g
  modified_base (3260096)..(3260313): a, c, t, or g
  modified_base (3260505)..(3261570): a, c, t, or g
  modified_base (3261798)..(3262070): a, c, t, or g
  modified_base (3262304)..(3262532): a, c, t, or g
  modified_base (3262780)..(3263122): a, c, t, or g
  modified_base (3263271)..(3264867): a, c, t, or g
  modified_base (3265141)..(3266308): a, c, t, or g
  modified_base (3266506)..(3267465): a, c, t, or g
  modified_base (3267766)..(3268320): a, c, t, or g
  modified_base (3268580)..(3270833): a, c, t, or g
  modified_base (3271089)..(3273205): a, c, t, or g
  modified_base (3273437)..(3277430): a, c, t, or g
  modified_base (3277641)..(3277821): a, c, t, or g
  modified_base (3278096)..(3280160): a, c, t, or g
  modified_base (3280449)..(3280684): a, c, t, or g
  modified_base (3280921)..(3280931): a, c, t, or g
  modified_base (3281150)..(3284451): a, c, t, or g
  modified_base (3284671)..(3285463): a, c, t, or g
  modified_base (3285737)..(3286015): a, c, t, or g
  modified_base (3286327)..(3286714): a, c, t, or g
  modified_base (3286923)..(3288102): a, c, t, or g
  modified_base (3288392)..(3290105): a, c, t, or g
  modified_base (3290286)..(3290644): a, c, t, or g
  modified_base (3290841)..(3292305): a, c, t, or g
  modified_base (3292502)..(3293508): a, c, t, or g
  modified_base (3293712)..(3294159): a, c, t, or g
  modified_base (3294253)..(3295678): a, c, t, or g
  modified_base (3295897)..(3295922): a, c, t, or g
  modified_base (3296138)..(3296499): a, c, t, or g
  modified_base (3296680)..(3298717): a, c, t, or g
  modified_base (3298881)..(3300180): a, c, t, or g
  modified_base (3300342)..(3301907): a, c, t, or g
  modified_base (3302209)..(3304136): a, c, t, or g
  modified_base (3304367)..(3307047): a, c, t, or g
  modified_base (3307245)..(3307258): a, c, t, or g
  modified_base (3307425)..(3307778): a, c, t, or g
  modified_base (3307974)..(3307977): a, c, t, or g
  modified_base (3308276)..(3309778): a, c, t, or g
  modified_base (3310075)..(3311599): a, c, t, or g
  modified_base (3311827)..(3312275): a, c, t, or g
  modified_base (3312494)..(3312796): a, c, t, or g
  modified_base (3313086)..(3313297): a, c, t, or g
  modified_base (3313346)..(3313615): a, c, t, or g
  modified_base (3313901)..(3314475): a, c, t, or g
  modified_base (3314631)..(3315786): a, c, t, or g
  modified_base (3316056)..(3316352): a, c, t, or g
  modified_base (3316633)..(3319175): a, c, t, or g
  modified_base (3319405)..(3320577): a, c, t, or g
  modified_base (3320866)..(3321091): a, c, t, or g
  modified_base (3321094)..(3321107): a, c, t, or g
  modified_base (3321376)..(3321821): a, c, t, or g
  modified_base (3322149)..(3322640): a, c, t, or g
  modified_base (3322901)..(3327311): a, c, t, or g
  modified_base (3327610)..(3329075): a, c, t, or g
  modified_base (3329456)..(3329938): a, c, t, or g
  modified_base (3330094)..(3332344): a, c, t, or g
  modified_base (3332539)..(3336139): a, c, t, or g
  modified_base (3336392)..(3337535): a, c, t, or g
  modified_base (3337717)..(3340103): a, c, t, or g
  modified_base (3340279)..(3341706): a, c, t, or g
  modified_base (3341972)..(3345145): a, c, t, or g
  modified_base (3345491)..(3345497): a, c, t, or g
  modified_base (3345783)..(3346604): a, c, t, or g
  modified_base (3346766)..(3347029): a, c, t, or g
  modified_base (3347288)..(3347503): a, c, t, or g
  modified_base (3347767)..(3348712): a, c, t, or g
  modified_base (3348842)..(3348886): a, c, t, or g
  modified_base (3349152)..(3351333): a, c, t, or g
  modified_base (3351537)..(3352255): a, c, t, or g
  modified_base (3352539)..(3355043): a, c, t, or g
  modified_base (3355309)..(3355530): a, c, t, or g
  modified_base (3355812)..(3356342): a, c, t, or g
  modified_base (3356563)..(3356592): a, c, t, or g
  modified_base (3356602)..(3357608): a, c, t, or g
  modified_base (3357788)..(3361443): a, c, t, or g
  modified_base (3361752)..(3365828): a, c, t, or g
  modified_base (3366131)..(3368322): a, c, t, or g
  modified_base (3368622)..(3369964): a, c, t, or g
  modified_base (3370252)..(3370817): a, c, t, or g
  modified_base (3371017)..(3371807): a, c, t, or g
  modified_base (3371947)..(3373566): a, c, t, or g
  modified_base (3373755)..(3375790): a, c, t, or g
  modified_base (3375983)..(3377395): a, c, t, or g
  modified_base (3377612)..(3377727): a, c, t, or g
  modified_base (3378001)..(3380329): a, c, t, or g
  modified_base (3380543)..(3382566): a, c, t, or g
  modified_base (3382891)..(3383786): a, c, t, or g
  modified_base (3384044)..(3384186): a, c, t, or g
  modified_base (3384475)..(3385740): a, c, t, or g
  modified_base (3385986)..(3386209): a, c, t, or g
  modified_base (3386474)..(3387189): a, c, t, or g
  modified_base (3387478)..(3388898): a, c, t, or g
  modified_base (3389065)..(3390386): a, c, t, or g
  modified_base (3390632)..(3391013): a, c, t, or g
  modified_base (3391230)..(3393880): a, c, t, or g
  modified_base (3394021)..(3399154): a, c, t, or g
  modified_base (3399306)..(3399521): a, c, t, or g
  modified_base (3399762)..(3402015): a, c, t, or g
  modified_base (3402285)..(3402297): a, c, t, or g
  modified_base (3402597)..(3406159): a, c, t, or g
  modified_base (3406365)..(3409023): a, c, t, or g
  modified_base (3409260)..(3410778): a, c, t, or g
  modified_base (3410976)..(3411201): a, c, t, or g
  modified_base (3411390)..(3411805): a, c, t, or g
  modified_base (3412045)..(3412055): a, c, t, or g
  modified_base (3412059)..(3412294): a, c, t, or g
  modified_base (3412544)..(3412784): a, c, t, or g
  modified_base (3413085)..(3415435): a, c, t, or g
  modified_base (3415699)..(3420047): a, c, t, or g
  modified_base (3420284)..(3422454): a, c, t, or g
  modified_base (3422651)..(3423711): a, c, t, or g
  modified_base (3423850)..(3424557): a, c, t, or g
  modified_base (3424758)..(3425080): a, c, t, or g
  modified_base (3425399)..(3426457): a, c, t, or g
  modified_base (3426755)..(3427023): a, c, t, or g
  modified_base (3427246)..(3428189): a, c, t, or g
  modified_base (3428437)..(3431547): a, c, t, or g
  modified_base (3431827)..(3432298): a, c, t, or g
  modified_base (3432559)..(3432692): a, c, t, or g
  modified_base (3432878)..(3437815): a, c, t, or g
  modified_base (3438032)..(3441139): a, c, t, or g
  modified_base (3441381)..(3441646): a, c, t, or g
  modified_base (3441833)..(3446421): a, c, t, or g
  modified_base (3446678)..(3449095): a, c, t, or g
  modified_base (3449332)..(3450918): a, c, t, or g
  modified_base (3451084)..(3458289): a, c, t, or g
nnnnnnnnnnnnnnnnnnnnnnnnttaaggaatagtactgaagactacacatcttttgcctttgttcagttttgagaggtttactctcaaaatagtttgttcattgaaaactggatatcgaagaaaatcaaaacaagtaacacacaccgagttgacaagttaaagagttttttaataagttcaacgcttattttcttgagcaaccttctatcgctagaagaagtactcaccgaccgtaaggtcaaaggttaagtgaataagggcgcacggtggatgccttggcactaggagccgatgaaggacgggactaacaccgatatgctttggggagctgtaagtaagctatgatccagagatttccgaatgggggaacccagcatcttttataggatgttacacagttgtgaatacatagcagctgtgaggtagacgcagagaactgaaacatctaagtacctgcaggaagagaaagaaaattcgattccctgagtagcggcgagcgaaacgggaaaagcccaaaccaacaagcttgcttgttggggttgtaggactccgatatggtagttgaaacagatagtcgaaatacttggaaaagtatgtcaaagagggtaaaaaccccgtagatgaaatctggctcacacctaggaggatcctgagtacggcggaacacgaggaattccgtcggaatccgggaggaccatctcccaaggctaaatactccctagtgaccgatagtgaaccagtaccgtgagggaaaggtgaaaagcaccccggaaggggagtgaaatagatcctgaaaccgtgtgcctacaacaagttagagcccgttaatgggtgatagcgtgccttttgtagaatgaaccggcgagttacgatagcatgcgaggttaagttgaagagacggagccgcagcgaaagcgagtctgaatagggcgaatgagtatgttgtcgtagacccgaaaccatgtgatctacccatgtccaggttgaaggtgcggtaaaacgcactggaggaccgaacccacgtacgttgaaaagtgcggggatgaggtgtgggtagcggagaaattccaaacgaacttggagatagctggttctctccgaaatagctttagggctagcctcggaattgagaatgatggaggtagagcactgtttggactaggggcccatctcgggttaccgaattcagataaactccgaatgccattcattcatatccgggagtcagactgtgagtgataagatccatagtcgaaagggaaacagcccagaccaccagctaaggtccccaaataactattaagtggaaaaggatgtggggttgcacagacaactaggatgttggcttagaagcagccaccatttaaagagtgcgtaatagctcactagtcgagtgaccctgcgccgaaaatgtaccggggctaaatagtttaccgaagctgtggagtgcaccataaggtgcattggtaggagagcgttctaagggcgttgaaggtagatcgtgaggactactggagcgcttagaagtgagaatgccggtatgagtagcgaaagacaggtgagaatcctgtccaccgtatgactaaggtttcctggggaaggctcgtccgcccagggttagtcgggacctaagccgaggccgacaggcgtaggcgatggacaacaggttgatattcctgtacccgttgtttttgtttgagcaatggagggacgcaggaggctaagaagtgcagactgatggatatgtctgttcaagcagtgagtcttagtgggagtcaaatgcttctactttcaaggacaagctgtgatgaggagggaaataatagtaccgaagcttctgatgtcacactgccaagaaaagcttctagtgagaaaacaatggcccgtaccgcaaaccgacacaggtagtcgaggagagcatcctaaggtgagcgagagaactctcgttaaggaactcggcaaaatgaccccgtaacttcgggagaaggggtgctgctctaacgagcagccgcagtgaataggcccaagcgactgtttatcaaaaacacaggtctctgcaaaatcgaaagatgacgtataggggctgacgcctgcccggtgctggaaggttaagaggagtgcttagcgtaagcgaaggtacgaattgaagccccagtaaacggcggccgtaactataacggtcctaaggtagcgaaattccttgtcgggtaagttccgacccgcacgaaaggcgtaacgatttgggcactgtctcaacgagagactcggtgaaattttagtacctgtgaagatgcaggttacccgcgacaggacggaaagaccccatggagctttactgtagtttgatattgagtgtctgtaccgcatgtacaggataggtaggagccgtagagatcgggacgccagtttcgatggaggcaatggtgggatactacccttgcgttatggccactctaacccgcagcccttatcgggctgggagacagtgtcagatgggcagtttgactggggcggtcgcctcctaaaaggtaacggaggcgcccaaaggttccctcagaatggttggaaatcattcgaagagtgtaaaggcagaagggagcttgactgcgagagctacaactcgagcagggacgaaagtcgggcttagtgatccggtggttccgcatggaagggccatcgctcaacggataaaagctaccctggggataacaggcttatctcccccaagagtccacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgttggaaatttgagaggagctgtccttagtacgagaggaccgggatggacttaccgctggtgtaccagttgtctcgccagaggcatcgctgggtagctatgtagggaagggataaacgctgaaagcatctaagtgtgaagcccacctcaagatgagatttcccatttctttaagaaagtaagatccctgagagatgatcaggtagataggtcagaagtggaaggccagtgatggttggagcggactgatactaatcgatcgaggacttaaccacgattgaaaaaagcaaggaaactcggaagagttttgattcttcgatccagttttgagtgagcaatacttactcaattgaatagtgtggtggcgatagcgagaaggatacacctgtaaccatgccgaacacagaagttaagcttcttagcgccgattgtagtgaagggtttccctttgtgagagtaggacgtcgccacgctgtttcattccggcatagctcagttggtagtagcgcatgactgttaatcatgatgtcgtaggttcgagtcctactgccggagttatcgatagctgtgaagctatcttttttttgccattttggagcggtctttctactagcggaaagatcgctctttttttgcagataaaagttaaaactattttgagagatcggaagagcacacgtctgaactctaccacagtagaaccacaatttctacaggtatggggagcaggtgagaaaacagcatcgacgatcaacgtctttttcttctgaaaggtctcgtaagagacctctgtaatcatcaaatctttctctattaatcgcagcatttttttgatagaatcattcatatagcatatcgtcctctcagttgtttattttgtcgtgatttaatcatactagagaacgatatgttttttaatacctaaaataaaaatggggctgaagaatcaattctgattcatcagtcccataaattatagagcctaaaaaagcggagttatgagatgacttcgtttttttatttgttttctttttcaaatagacaagatactggtaaaataaagaaaagaaagggagcgaaaattatggcaaaacgtgtgattgtaatgaatttcaacgcaaactcggaagcattccaagcattttctgaagtaaaacgcatgcatatggaacgaaaaatcaaaggagaacaaatggctgtgatcactcatacagaatccggtgcgcaccagttcaagatcgaagattttctagactttaccggtaataacaaagcatcgactggtggaatgattgggatgctagtaggaattctgggaggaccattaggaatcatgttaggctggttcggcggtagtatgattggtgcgacacgagacgccaaagaaatccaaaatgcacaattgctgtttgaacatgtcagcacccaaattggggtaggcgacactggcttattgttgattgcagatgaggaagacaatcgtccactaaatcagttgatcatgaatcaattaggtggggaaattactcgctttgactatgatgaagtagaagcagaaattgaaacggctaaaaaagtcgaagaaaaaacgaaagcacaagcgcaagaagattggaaaaagtctcattcccaatctgaagaagaacaggaataaactataaattgcatctgaccttcgtttccgctaaaattgggggaagatgaaaggaaagaagtatatggaattagaatttttaggtaccggtgcaggcgtaccagcgaaacatcggaatgtaacaagcacagcactgcggttacttgatgaacgcaatgctgtttggttgtttgactgtggtgaaggcacacaaatgcagattttgcattctacgattcgcccacggaaaatcgaaaagatattcattactcacttacatggagatcatatttatggattgcctggattgatcagcagtcgctcctttcaagggggcgcttcaccgttagagatttatgggcccataggtattgaagaatttgtgcggaccgtgttaaaaatttctcaaacaaaattgagctacccgttagtttttcatgagatcacaaaagaaggcattctcttcaaggacaaacagtttaccgtttcttgccgtcggttggatcacggaattgaaagctttgggtatcgagttgaagaagcgagtcaccaaggagagcttcaggtagaagctttgactgcattaggaatcaaaccgggtccagtttttggtcgactgaaaaaaggcgaaatcgtcacgttggaagatggacgacaaatcaacggaagtgactatgtaggtgaagcgaaaaagggacgtaccgtcacgattttaggagatactcgcctttgtgccaattcgatcttactggctgaaaatgcagatgtactggttcacgaaagtaccttcaataaagatgaagctaaaatggctcgcgcctattttcattctacaacggtgcaggcggctgaagtagccaaacaagcgcaggtaaaacgattgcttttgacgcacattagtgcacgctatgttgggaaagatattacaattctggcaaatgaagcaaaagctgtgtttcctaatacggtgatcgtgaaagacttcgatgtcatcgatgtcccatttgcagaaaaaggagatcaagatgttgttagaaaataaagtaattgtcgtaactggcggatctgctggcttaggggaacaaatctgttatgaagcagcgcgtcgcggtgcgatcgtggtgatttgtgcccgtagaagtcagttgatcaacaaagtcaaagaacattgtatgacattaagtggcaaaccagcttatgcctttcaattggatattgcagaccctgaaagtgtcgaaaatgtcattgcttcgattcgtgaaaaggtcggaaaagtggacattcttgtcaacaatgctggttttggtatttttcaagaatttacagaaatgaaaccagaaacgatccgcaatatgtttgaagtgaacgtattagggatgatggtcttaacacagcaaattgctttagaaatggtcgatcagcgctctggtcatatcatcaatgtggcatcgatggctgggaaaattgctacaccaaaaactgcagtgtattcggcaaccaaatttgctgtattaggtttttcaaatgcgttgcgtttggagttgaaacctttcggcattcatgtgacaactgtcaatccggggcctatcgaaacagccttctttgaccaagcagatcctagtggcaattatttagcttctttagggacatttgttcttgaaccaacaaaactggcaaagaccatcgttaaagcgatgattcatccaaaacgagagatcaatcgcccacaagtgatgggagtagctgcaaaattctacacactattcccagctattggggactacttggctggaagtctattcaataaaaaataggagttgtttttgatgaaaaatcaatggcgagtaatcgtaggtattttgttggttttagtgatcgtcctttttgcggtcgccaataatatgactgttccaatcaattttggctttactagcatcaaagcgcctctgatcttgattatcattggggcggctttgttgggggcactgattatcttactagtgtcaactagtacgatgttccaacaaaagaaagaattaaaaagattacggaaagaattggctgactttcaacaaaataatgaagaaaaatttcaagaacagcgtgaggtattagaacgggaatatgcaaacaagcaagcagacctcgccttgagggaacaacaaattgctgaagcagaagcaaaaactgcggcagttgtgcctggtgaaccaccaattatagaaaatcgtcaagatacgtttccagagtaatggtaagcttgcactcttgtttttcaaaagagggttttgggactccaaccagaacggtaaatctctgaagtgaggcgcaagattggctcaccactcttttgcaacaaatgagcgaaataaaaacgacatccttcggtggtctttcgataaacgaccgaaggatgtcgtttttattgtactagaaataggatagaagctggtagtgcttttttggtcaacgcttttcttttctccaaaatatttgctataattaccaagttaggagtgattgtgtgaaacgcgcgaactttcattggctgagaccacaaaaaagtgaattatcagctaatttcgaggaaatgatccaagcaagaggtttgtcaccattaataggtcaattattatggcagcggaatattcgaacagcagcagacttgcaaagttttttagaaccggatttgcagggacttcatgatccatttttgttttatgatatggaaaaagccgtcgatagaattcagacagcgatcatgaatgaagagcgtattctgatttatggagactacgatgctgatggtattacgagcacgactgtcttaaaagaagcgctggaattattgggtgcggatgttgaattttatctgcccaatcgctttaccgatggctacgggcccaatctttccgtttatcaagataaaatcgcagctggtgtgcaattgattataactgttgataatggtgtatctggtcatgaggcattggcttatgccaaagaagcacaggtagatgttatcgttacagatcaccatgagttgccaccagaattacccgatgcgtatgccatcattcatcctcgccatccattaggaaattaccctttttcagatttggcgggtgtcggagtcgcattcaaagtcgctactgcgttattagaagaagtgccagtcgaattattagatctcgtggcaattggtacgatcgccgacatggtgtcgctcactggtgagaatcgcattctggtcactaacggattaaaaatgatccagcaaaccgaacgtgcggggctctcggcactgatcgaagtgagtggtctgaagaaacgggcaatcaatgaaacggatattggttttgccatcggacctcgtttgaatgcgattggacgcttggaagatgccaatcctgcggtaacacttatgtcgacatttgatccagaagaagcccaattgttagccaatcaattagatacgatcaatcttcaaagaaagcaatatgtggaaacgattttgaaagaagctcagaatatgctttccgattcaaatcaagtccatttaattgtgggagatgattggcatgaaggtgtcttagggatcgttgctggacgattgatgcaacagactggcagaccggtccttgttttaaccaaaaaaagcaacggtattgctaaaggttctgggcgcagtgttgcagcattaaatctatttgacatgctctctggaatgcgtgaaatgtttaccagctttggtggacaccatgcggcagtagggctcagtgtgcccattgatcacctttcgatgctccaagaacgtatgaatcaatacgtggtcgataatcggatcgacctttctagcgggattccgttaccgattgatgaagaattgtctttagcagaaattacgacaaattttatcgagtcgctgaaaattttagctccctttggtacagacaacccaatcccaaagtttttgattacgaatatttctgctgataatggccgacaaattggtacagagaatcagcatttaaaagtcagtcttacagatggagaaaatggtcaattagatgtgatcggttttggttttggatcacagctagtagaatttgagagtgaaggattggccgttgtggggcaattatctgtcaatgaatggaacggcaagaagaaaccacagctgatgttggaagattttgaagtcaacggcatacagctgttcgacttgcgttcaaagaaaaatcggcaagggttgatccttgatgcccaaacattaggtattgctttttcggataaattgccttcagagatagaacgattttgtccgaacgttcatgtttatcaaacgttagacgatttgacagctttttttggttcaggaaattatacgcaactcgcttttctagactgtcctagcgagaaagagcttttgagaaaaatcattcaagaaatacctgtcaatcgtatctatttgattttagtatccacagaggatgcttatctggatggtgtcgggactagggaacaatacggccgtttgtttcaactgatcaatcagcagaatgggattgatattcgctataaactgccaatggtagctaactacttgcagattccagaaaaattattaatttttatgattcaagtgttttttgatttgaaatttgttacaataaaagatggcgttttgaaaaaagtccctgatccagagaataagccgcttactgagagtgtgttgtatcaacagcgacttgcaaaaatcaaaacagaagaagatttactaatgagtgatttatcaacgattcgcaaatggttgatatcttaggaggaaaaaacatgaatttaaaagactatattgccagcattccggattatccgcaagaaggaattgtctttcgcgacatctctccattgatggctgatggagaagcttatcgttatgcaacacagcaaatcgtcgagtacgctcaggaaaaagggatcgacatggtggttggacctgaagctcgtgggtttattgttggttgtcccgtggcgtatcaactgggtgttggttttgcgccagtacgtaaaaaaggcaagctacctcgaaaaacgattgaagcaacataccagaaagaatatggcgtggatattttgacgttacacgaagatgcgattaaacctggccaacgggtattgatttgtgatgatttacttgcaaccggcggcacgattaaagcaacgatcgaacttgtggaaaaattaggcggcatcgtagttggctgtgcttttctgatcgagttgatggacttgcaaggcagagacaaaatcactggatacgaaattaaaacattgatggaatattaatcgaaaaaagccagatcaattttgatctggcttttttttgtttgtttggcagcaacactgaaataatcgacctactgttcgtaatgataaaaatcatggtcgtggtaataagtttggtttctctttcgttctgcttggcggaatttcttttcatcccatagcatgaaccacagcatcatcaaagggcaaaaaatcagaactgcactgagtacgccaaaataaccaataatgatccctgttaacaacacccacaaaataaaaccaaatcgacgaactgctttcattattttcactccttataaaaatgcgaacttatgtttgtaaaactattatacgaatgtttgttcggtttgtaaagaggaaataaaaaaaatcttcgaaggttcgaagatttaaggaatcgattaaagtaagtgacggtagagaccaacgactaagcctaaaatcgttacatctggcaagatgataggttctaggtaatcattttccggttgcaaacgaatgtgatcctgttctttgaaaaatctcttacaggtggcttcatcttcatccgtcattgcaatgacaatgtccccgttttgagcactttgctgtttgcgaacgatgacttgatcaccgtctaagattccagcgttgatcatactttcaccgcgaatcgtcaacatgaacaaactgccgatgctatttgctaaatcaggcggtatcgggaaaaaatcggaggcgtcttctacagctaagatcggttcaccagccgtaacgactcctagcattgggatcgagtttggctgcacatcgattttttctaatccggaggaagtcaattcaatcgctcttggttttgttgggtcgcgtaaaatcaagccttttttttcaagcctggataaatgtccgtggacggtagaagtagaggatagctgaacggcttcgccaatttcgcgaacagtcggcggatagcctttttcagtgactcgtgtatgaataaacttaagaatctcgatttgtcgattttctgttcgttttgccaaaactgacaccttctttcatttgatagtcttagtgtaccataggagaaacgacaattcaaacaaatgttcgctttttgttgctattgtttttttgtcaggttttgtataagataaagtagtgaaaaggaggtgtcgaaatgttatccaaagaaaaattagcccgcattaatgagctagccaaaaagaaaaaagtgcaaggtctatctgctgatgaaacgatcgaacagcaaaagcttcgcgaagaatatttacaagcttttcgtggaggaatgcgacaccacattgaaggaatgaaaatcgtcgatcctgaaggacacgatgtcactccagacaaattaaaagaaattcaaaagaaaaaaggattgcatggcagataaagatgaattccttttcattcctattgaaatcctgaaagaaatcccgtataatatgagatgtaataaaggtaaaaaaaacctaaattaggaggaattaccattgtttgataaaatcgatcaattaggtgtcaacacccttcgtacattgagtatcgaagccgtacaaaaagcaaattcaggtcatcccggtctgccaatgggggcagcgccaatggcgtatgccttgtggaccaagcatttgaaagttaatccgaccacttctagaaactggatcgaccgcgaccggttcgtcttgtctgctggacatggttctgctttgctttacagcttactgcatgtttcagggtatcaagtaaccacggaagacttgaaaaatttccgtcagtggggcagccgcacaccaggacacccagaagttgggcatacggatggtgtggaagcaacgactggtccattaggacaaggaatcgcaatggccgtcgggatggcgatggcggaaaaacatctagcggcgacatacaaccgggatgaatacaatgtgatcgaccactatacgtatgcattatgtggcgacggcgacttgatggaaggtgtgtctcaagaggcagcttcaatggctggtcatatgaagctggacaaattgatcgttttatatgattccaatgatatctcattagatggacctacttcaaaagcattcacagaaaacgttggtgcccgttttgaagcttacggttggcaacatttgttggtcaaagacggcaatgacttagaggcaatctcacaagccattgaagcagctaaagctgaaacagagaaaccgacattgatcgaaatcaaaacagtcatcggttacggtgccccaaatcaaggaacctctgctgtccatggtgctccattaggtgcggaaggtatttcagccgctaaagcaatctatggctgggagtatcctgaattcaccgtgccagaagaagtagcggctcgtttcaaagaaacgatgatcgatgaaggccaaaaagccgaagcggagtggaacgagaaattcgctgcttacaaagcggcttatccagaattagctgcgcagttcgaacaagcagtggctggcgaactaccagcagattgggatgcagaactgccaacttatgaagtaggcagctcacaagcgagtcgtgtttccagtaaagaaatgatccaagctctttcaaaagctatcccaagcctatggggaggatcggccgatctatccggatccaataatacgatggtcgcagcggaaaaagattttgaacctggtcaatatgaaggccgcaacatttggttcggtgtgcgggagtttgcgatggccgcagccatgaacgggatccaacttcatggcggtacacgcgtgtatggcgggacattcttcgtctttgttgattacttgcgtccagcagttcgcttgtcggctctccaacatgcgccagttatctatgttctgacccatgattctgtggctgttggtgaagacggaccgacccacgaaccaattgaacaattggcgagtgtacgctgcatgccaaacgtgcaagtgatccgaccagcagatggcaacgaaactcgggcagcttggaagatcgccttgcaaacgacgaataaaccaacggtcttagtgttgagccgtcaaaacctgccagtgttagcagggacgctaagtggtgtcgaagaaaacgtggctaaaggtggctatgtcctttcaaaacaaaccggtgagacaccagaaggcatcttgatcgctactggttcagaagtgaatctagcggtagaagcgcaagccaaactcgcagaagctggagtggatgtgtctgtcgtatcactgccaagctttgatttgtttgaagcacagtcagaagagtacaaggagagtgtcttgccgaaagccgtgaaaaaacgggttgccatcgaagcagcttccccatttggttgggatcgttacctaggctgcaaaggcaaagtcatcgccattgatcattttggcgcttctgctccaggaaacaaagtattggaagagttcggctttacagtcgaaaatgtggttgccactttccaatcgatcaaataagcgtaagaaacaagcgaaatcgcagctgatttcgcttgtttttttaaagtcttttcgtttttaggtagaacaagatgtttttgcgaaaagacttttaaaaaactattgagttgcttaagttgcacagaaaaaattttttccgtataatgtctatattgttgaatagtattgggacgatggaggaaaagaatgaaaaattatcaaacccgcagtgaaagacatatccaccaacaaaaagcagtgatgccacgaccaagtaaacgagcagtggtttcttttattggggctggattagcattgtcaccagcggtggtcacgctacttcccgaacaggtccaagcaagtgaatatcagaccactagtcaaggaatcgctagttttatcgaacagattggttggtcagcacaagacgttgcggccaataatgatctttatgcatcggtgatgatcgcgcaagccattttggaaagtggctatggctcatctacattatccaatgcgccttactacaatctttttggggtcaaaggatcatataacgggcaatctgtctatttgcctacagatgagtatatcaatggacaatgggtcgtaatgaatgaaccattccgccaatataattcctactgggagtcttttcaagatcacgccaacgttttaagaagtacaagcttcacttcaggtaaagcacattatagtggggtctggaaaagtcaaacgacttctttttacgatgcgaccagctatctgacaggacgctatgccactgatccaggttacgcacaaaaattaaactggctgattgaaacgtatcaactaactcgttttgatacaccaagtactggtgccacaacgacttctgtaacgacaacgacaacgcaatccacatcgacgacaacaacgacacaaagtacgggacaaagttatgtcgtagcatctggcgacagtctttgggatattgcttcacgttttggaacaacggtggatcaaatcatggctgccaatggattaagcagtgacttgatcgtcgtaggacaggaattgatcgtttgattttcgctatttattagctaaacgccaaatgaaatttcacaaaaacttttgtttttgttctcttttagtaactaaaagaagcaaagcaaaagtttttttctttgtgaaaaaaacataaatatttggaaaacgctaactttttgttcgcaagtctgccgttttttgggtagaataggaatatgaactggagggattgcaaatgacaaagatttatcaatctgttaccgagctagttgggcatacgcccatcgtcaaattaaacaaggtggttggagaggattccgctgatgtctacgttaaacttgagttttataatccagggagcagcgtgaaggaccggatcgctttggctatgatcgaaaaagccgaaaaagacggctctttgaaagcaggcaatacgatcgtggaaccaacttccggtaatactgggatcggcttggcgatgatcggtgcagcgaaagggtaccgagtggtgatcgtgatgcctgagaccatgagtatcgaacggcgcaagctgatgcaagcctatggtgctgaattgattttgacaccaggctcagaaggaatcacaggttcaatcaataaagccaaggaattggctgaacaagagggctattttatgccgctgcaatttgaaaatccggcaaatcccgagattcacgagaaaacaactgggaaagaaatagagaatgcctttgaatcaaaaggattagatgcctttgtcgctggtatcggtacaggcggcacgatcactggtgcgggtcgagaattaaaacgagtgtatccagacttaaaaatctatggcgttgaaccggcagaatcggctatcttagaaggcggacaacctggtcctcacaaaatccaaggaattggaaccggctttgtacctaaagttcttgatacagagatctttgatcaagcaattgccgtatcaagtgaagatgcgatggcaacagcgagagaagtcggccgtaaagagggcttgctcgtaggtatttcttctggagcagcgatccatgcagcactcaaagttgccaaagaactgggaaaaggcaaaaaagtcttagcgatcgtcccggacaatggagaacgctatctatcgactgctttatatcaagtggaagaataacaaggaaagcgggcattggcagaatgcctgctttttctccccttttcttaaggactgtggaatttttcgtgtttgttttgtggttgattaagaatttttagagaaagctgtttgaatttttaccatctacatagtatgatattacagataagagaattggaggaactcctgtgaacacgatatatgatgaggcaatcaaacaattaaaacaagaaaatatccgtatcactccacaaagggttgcgatacttgagtttttggctagccacgcatcacatcctaccgcagaagaaatttaccgagcgatcgaagtccactttcccggtattagtgtagcgacagtctacaataatctgcgactgtttacggagatcggttttgtgaaagaaatgaactacggcgatgcatccagtcgctttgactttaagacagagccgcattatcatgcaatttgtcaacgttgcggcaagatttctgatttttactatcctggattggaagatgtcgaaatggccgcttcccaactgaccggatataaaatccaaagccatcgcttagaagtatatggattgtgtccagagtgtaaaggagaagaggaatgaaaattatttcaacggataaagcaccgcaagcaattggtccttatgtacaagcacggattgctaatggtttcttgtttgcttccggacaagtgccgttagatcctgttacaggagaagttgtgggagcaactatcgaagttcagacacagcaagttctcaaaaatatcgaggcaattttaactgccgccggtattacaccagatgaaatcgtcaaaacaacatgtttcttaaaaaacatggatgattttgttccattcaataatacatacagcacactttttcatgaacatttgcctgcacgttcagcagttgaagtggcccgtttaccaaaggatgtattggtggaagtagagatcattgctgtggtggcacaataaaggagtcaatgggacggtcgtatatatgcgcagtcccatttttgttgagaatggattttattcttgatgatgccaaaataaaattgaaaatggtttttatgtaacgatgggaaaagaggacaataagatgatttctttacaagaatatttagcccaggggcaaacaactgtctccaatctgcttttggaaaactatcatagccttggtttaaccaatgatgaatttgtattatggcttcagttgtatcgttaccacgaacaaggcaatgattttccagatttagcgatgattgctaaagggatgggaagtgagcaaaaagaaatctataaatggttgaatgagctattgaataaacagatcatcgccatcgaatccaagaaagattcagcagggaagatggtggattactatgagttttctggaatctatgaacgactggaagtttgtttgcggcaaaaaaatcagcaggaggaaaagcagagctatgattcaaaagtacgttcgctttatcaaatgtttgagtccgaatttggccgtccgctttcagcaatcgaataccagcgaatatcacaatggctggaagaagataaataccagccggatttgattcaatttgcgttacgtgaggcggttttgaatcaagcctacagtttgaattatattgatcgcattttactttcttgggaacggaaaaatattacctcgaaagaacaagtagaagaagaacaaaaacgccgtaaaaaacagtttatgcagaaagaaaatttggaacaaacgaatggaccggttcctaagattcctatgcataattggttagaaggggaataaaggagagttgccatgatcagtaaagcaaaaactatgatcgcattggaacaaatgtaccaaatgttccccgacgctcacggagaactgatttccaaaaatccgtttgaactgttgattgctgtgattttaagtgctcaggctacggatgtgtcggtcaataaagtgacccccacactatttgctgcctatccgacacctgaggccttggcagcagctcctgttgaggaaatcattgagaaaatacggacgatcggtctttatcgcaacaaagcaaaaaatatcaaggcttgtgcgtcccagcttatcgaacgattcaatggccaagtacctagaacccgcgaggaattagtgtcattaccgggggtcggaagaaaaacagccaacgttgttttgggcgatgcgtttggtattccggcaatcgctgtggatacccacgtcgaacgagtaaccaagcgcttacggatttgccgattagatgcaaatgtcttagaagtagaacaaacattgatgaaaaaagtgccagaagatctttgggtcaaaacacatcacacactgattttctttggacgataccattgcacagctagagcgccaaaatgtgaagtttgcccattattgacaatgtgccaagaaggacaactgcggatgcgcgcaaaaaaagttcagccacctcaatgagaggcggctgaacttttttttattcaggatttgtttcatttgtccctggagtagtcgacgaagatgatggcgtcgaacttgactccgaagaagacgatggtgtgctttcactttctgacggtggcggtgtagattgtgagctttcagaagaagattcaactggtggaatcgattcttccgttgaactgctagattcaacgatttcagaactgctttctggtgttgattcaggaagcgaagaagagctgatcgttgatcttgtgctagaacttggttgctggtaagtccctttgatgtaaagctcattgccgatccgggtcaaatctgcgggcattttccagtcgcggttctcaacagaggctgagacaaattgcatcaattcccgataaacatctgaggcaacatgagtactgctgtctgtgatcggcgtcattttatcattataccctgtccaaacagctaaagaaaaggatggggtataacctgcaaacgtgatatccgggtaagcaccgtttgacgtatccaattgagccaattgattgtcatcatagttggaagtcccggttttcccagcttggtaaagtccatcgatttgggcattggttcctgttccgacagaaatcacgtctttcagaatatcggtgaccatataggctgtcgtatcatccatcgctttttgaccttccactttgaaggagtcttcatcaactgttccatcttgcgaaacgatcttattgacatattgcggctcgtaataggttccgccatttgaaaaggcagcataagcagcagccattttcaagctagagatcccatacttggtgccatcgatttctgatgtgttgctggaaattgcattggactgttcaatgtttttgtattcaatacctaggcctttcaagaaggaagaaatattgtcagcacctacttcttcaaaaagctttgctgctggaacatttctcgattgagccagtgctgtccgcaaagtgatatttcccatatattgtcgatcccagttgtagattggtgtgttcgtccccacgtaattatagggttcgtccaaaatcatgcggcctgttgaattttgtaaaaattggaaggctggaccatagtctgtcagtggtttaacggttgagccaaagtcacgagtgacgttgactgctaaattattacctaagacaacatcgtcttccacatgacgagcaccgatttgcgcgacaactttaccactattaacatctaccagagtagcggctacttgcattttatcatctgggaaattgatgtattcgtcactattaacgatgtcatacaatcgtttttgggtattgacatcaagattcgtatagatgtccaatccatccgtatagacatctttgccggtttttgcttttacttcatcaatcacttctttaaagtaattgtcataatatttccattcgttatttcgttgcggatttttttgcaatccttctgaaatatcttcggctttggctgcttcatattcgtctttagtgattttttcattctcatacatggttaacagaacaagatctcgtcgctgtttagctttgtctgggtgagcatatggatcataagcagaaggggcgtttggtaatccagcgattaatgctgtttgagccaaatctagttgatccaatgtcttgttatagaacttcatggcagctgtctgcatcccatagacaccgttagacatgtacactttattgatatagtaggtcaagatttcttgtttggattttgtttgttccagtctgacggccatccaagcttcttgcgcttttcttcgcaacgtctgatcttctgcactagtagagaagaaggatagtttgatcaattgctgtgttagggtactcccaccttgcatgccaccagtcgtcacgttcgacaatgccgatccaatgatacggatagggtctactccaatatgttgatagaaacgacgatcctctacagatacaatcgcatcttccaattgctgcggaatttcattcgcagtgattttttcacgggtctcgctaccaaaatcgaggatcagatctccgtttgaggcgtagaacctggaggaagcagcagaatcgagctgtttctcatctaatggtggtgcatctttagcgtaccaccaaaaaagtcccatccctgataagagaccgagacatcctaaaaagaagagccccataaaggtacgaagtaaaatactgccaatcgttcgttttcctttcggctttttttgtttggggcctttatatgcagccgccgctttcttagaatcatgtcgagaagctctcgattgcgattctttcgccatactaatcattctccttcattgacaaaaattgatctactgcttttaaataaggaatacgcggagcgattcctgggatgatctcaatgccgtttttctctatataggcaagaggcagcgattttttacctgttgttttttgttgatgccactctgtgatcaagttgctgctcgtcaaaaaaaagcagcgttgcaagcttgagaaccataacaagacaaagcagactccttgctgcgtcagacagttttccatatgctgaatctgatgctcatgaaaatttttgaaggggaaagaggttttgttctgtgtctctttggcttcaaaatccaagtaatatccgcgataaacaccattatagtccgtggtagaggcttctcggaagtaagcttctttaatcacagctgcactgcggcggggataatccaccttaacgatctgaacaggtgtaggttttttatgaatgactgctgcttgacgattcaaataataggcattgctttgattaattgcttcttcaaaacgcattccgcggttcgcgaaagtttttggccgagctattttttcttgcaatttttgttttttaccgccatcataagcagaagactgaccgttagggtatcgaatgaccatgttattcacactcctaggcatcattataccaaaaagacgtttggaaagaaaagagatgactgcttaaacaatgaaaaccttatattttaccggctaccgcagctttgaacttggtgtatttcaagaaaaagatcctaaaatcaaaattattaagaaagtaataaaaatgtctttactttcttacattgaacaaggactggaatgggtgctgatcagtggcaatctaggagcagaaatatggtgtgcagaagtggtggagcttttgcaaaaagactatccagaaatcaaactagggatcatttatccgtttcaaggatttggtgaaaactggaatgaagcgaaccagcaaatgttgcaacgagtgcaaatgagcgctgattatgtgaatgccactagccatcaaccctacaaagaaccaagccaattaagaaatcatacccagtttctattggaacacacagatggtgcgttgctgctttatgatgaagaattccctggaaaaaccagcttttttttgaaagatgcgaagaaatatcgggaggatcatccttacgagatcgatcaaattacaatggatgatctgcaaaacgcaacatttgatagtaatttactttgatttctgagagttttttgatagaatggtctagaaagtgaaaatcatttggaaaaatcaatgaggtgtaaataatggcaaatctaatttttagtcccaaggatattcttcaacaagaatttaaaacaaaaatgcgcggctatgatccagtggaagtcgatgaatttttagacaatatcatcaaagactacgagagctacaacaaagagattttagcattgcaagaagaaaacgatcgtttgaatgcaaaaatcgatcaactttctaagaaccaagcgattgcatcacgggtccaacaagaagcgccaaaaagtcaaacagtgacaaattttgatattttgaaacgtttgtctaatttggaaaaagaagtttttggcaaaaaattggatcaagaagaaccagttacacgttcctcttcatacaacagcaactacacaaatgctgattttgaagacgataacgaaaaaacacgtcaattctaatcaatttgattgctgtggttttcgggtaattgcggcataactttgattatgctgaggaaagtccatgctcgcacaagctgagatgcttgtagtgatcgtgcctagcgaaacaataagctagggtacttgaaagagtaacggcaggaaaaatggctaaggcgcgagctatgccaaagtatccttgaaagtgccacagtgacgaagcaagacgggaaaccgtcttggtggaacgcggtaaacccctcgagcgagcaacccaaacaatggtaggggcgctttttgcacggaaatgaacggagcaaaaaggcaagtaattgcagatagataattacccaacgttttcttctccctgaggaagacgtggacagaacatggcttatagaaaatcacagcagatcagggaatccttccagcaacggaaggtttttttatatcaagaaggagaaatctatgacagaaaaagtatttgattgtgtcgcaaccgctgctagtgggttagaagcgctagttggtaaggagttgcgagatttaggcattgaatgccaagtagaaaatggacgggctcgtttcaaaggaacgttggagaccattgcaaccgccaatctctggttacgcacagctgaccgcattaagattgtggtgggagaatttgatgtatacacctttgatgaattatttgagcaagtcaaagcattaccttgggaagactttctgccgctagacgcagagtttcctgtggcaggtaaatcgatcaaatcgaagttattcagtgtgcctgattgtcaggcaatcacaaaaaaagcgatcgttaatcgattacgggaagtttatcatcgccctgcaagtgttcctttaactgaaagtggtgctttctttcagttggaagttgctttgttgaaagatcatgccatgatcacactcgatacgacaggaccgagtttgttcaaacgtggctatcgactagaaaaagggggcgcacccttaaaagaaaatatggctgcagcattagtcatgttgaccaactggcgcaaagaccgaccgtttgttgatcctgtatgcggttccggtacactgtgcatcgaagcagcactgatcggacataatattgcccctggattcaatcgctcctttgtctgtgagacatgggattgggttccagctgaagtatttgagactgtaagagctcaggcagacgaagcagccgattacgatagacaactggacattatgggctcagatatcaatggacggatgatcgaaatcgccaaagcaaacgcggaagagattggtctaggtgattccatcaccttcaaacaacaagcagtcaaagattttaaaacagacaaagaatacggcgtgatcgttgccaacccaccatatggggaacgtttaggagaagaagagacggtacagcgcttgtaccgtgaaatgggcgaagtctttcgaccattaaaaacttggagcaaatacattttgaccagtgaccttacatttgagacccactatggtgaaaaagcaaccaagaagcgcaaactatataatggtgcgttgcgtacggatttcttccagtattggggcagtcgcccaccgcgtaaaaaggagacggttgaatgaaagaacaagaatttctaaaagaattaaaagagctcgatttgctgtcacaagcaatgggaatccttggttgggatactcagacgggaatgcctgaaaaggccagcgaatatcgcagtgaagttgacagctacttgtatggcttgtatttcgaaaagaaagtcggaccaacgatccaagaagccattacttattttggtcagcaccctgatgaattatctgaagttggtcaagcagcttatcagctggtgaaagaagaatatgagctgcaaaaaaatgttcctaatgaattagcgatcgcagcttctgctgctacttctagagctcatactgcttggacgcaagcccgcaaagcgaaagatttctctttattcaaggaagcattagctgagaatatccatttgacaaaagaactgatcccttattggaaaaaaaaggaacggacaaattatgatgttcttttgaatcaatatgaaccgaacatgaccgttgaaatcttggataatgtgttttcacaagttcgtgatggaatcatggatattcgtcgccagttagaaaaaggtactccaccagatacaacgatcttatctcgtgaaatgacagaggcgcaacagcggaaattcatctcgaaagtcatcacagacttagggtatgatttttctcgcgggcggttggacaatacggtgcatccttttgcgaccggcattaaccacaatgatgttcgcttgacgactcgttggaatgaagaagatttttcgatgggaatattcggcgtgattcatgaagcaggccacggcatgtatgaacaaaacattgatgaaaaatttgaaggaacgccgatccacgaaggagcatccatgggaatccatgaatcgcaatctttattcaatgagatcattatcggtagcaatcgtaatttttgggagaaacaatacccttattttcaagagtgtgcagaaggaactttcgatgatgtttcctttgagactttctacaatgcattaaaatttacccaagcaagtttgattcggatcgaagcagatagcctgacgtatgttttgcatatcattatccgttacgagattgagaagatgattttcaatgaagaagtgaatgtggaagatctgccaactatttggaatgataaatatgaagaatacttaggcgtacgtccgcaaaatgatttagaaggtatcttgcaagacgttcattggtcagggtcaagttttggctatttcccatcatacgcgttaggatacatgtatgcggcacagctttttcatgcaatggaaaaagagatcgatgtcgatgctgtattggcttctgatgattattcagagatccgccaatggttgaccacgcacattcatcaatacggggcttctaaaaaaccaaatcaattgattctggatgcgacaggagaactgttaaatccgcaatatttattggattatctgcggaaggtttatttttctgtttatcaaatccgctaatgagcaagcctttcgttcactcgaaaggcttcttctcatctttaaaaaaaccgcacgggaaactagttagctagacgatagtctttattgactttaggttctgatactttgatggaatcggacgattgaatcagaatgctagcaatagaaacaagataaaaaagacaggagtttcaaaaaatggctgatatagcaccaatttatgaatatgccaaattgattttgggaactgatcacacagggcatggctttgatcatgtcaagagagtagccgcaatggccaaacagatcattgccgaagatcaactgcaagtagatgattatgttgtggaagcagcggcatttttacacgataccatcgatgataaggtggtgaaagatgtggtgaaagccaaagaagaagtgcagcaatgccttctcgctgctggagccacagcagaacaaatcagtcatatatttacaatcattgagaatctctctttctcaaaagagttactggcaggggcacaagtctcctctttagaaggacaaatcatgaaggatgcggatcgcttagatgcattaggcgcaattggtattttgcgtactagttactttggcggtgcacatcagcatccgatccatgaatcagagcgagcgccgaaaacgttcacaaaccacgctgactaccgaaaagggaccaccgtgatcaatcatttctatgaaaagttgtttttattgcctgaaaaaatgcacacgcactttggtaaacaagaagcactgcggcgtaaagactttatgacaacctttttaactgaattttatagagaatgggatgtttagtaatttttaatcttcagttcgattcctttgtgtttcctctgtatttatctataattataaataaggggagagatggatatgtattacaaacaagcgctgaaaccgaatgaattattacctgcactttctgattctggggaatgtttttttatcattcgagcagcattacccatccggaattatcaagttgccatttaccggtacgatgatgagtattttttattgcaagatgaacgtttatttaatcagatctctagtatttccagggaacggcaaggagatgaagaacagattctgccattcattgaagaagcattagaagacaatcactattttctagtggaaaaagagtttatccgcttggatttattgacgctacaaaaaatgacaaccattcaatcgtttgaaatattgttttacgaattctttgatttttgaggtgatgggtgatgaaaaaaacggaatacctaaccattgaggatgcagcactcgctgatttatttcttgatctgggtgataagtacagcaacctcgaattgattgacgaagaaaaagatttggatgtggtcgttttgtcaaatagcgactggcaatatcttttggaacaactggatgatgaagtcaaggagcaatttcttgcacagaccgagactgattttctagacgaggagtaagaatagaggggcaaatgcccaatgaatgtatgtaggttaaagaaaaacagaagaacacaaaacaaaaaaatatccgaacgatagtcgatgaagaatgcgatgcgcttaacttaagtccgcatgcatgtaagtacgcttgatcattcagctatcgttcggataattgttttgtttgacggattcatttgtttttcagagcgcctgtcagtcaacatttgaataaagtgaaactgtatctttttcatttggattggagacgtacttttttgattttagcataaccccgaaaaatattgcggatcactaacaagagaccgatcagcaacggaatagctaataagtagagggaatagccatggacctgctctaccgcagcagcattggttttatttacttctgtcagcgcctgttggatcacttggaaactgaatacactcataaatccagcaatgataaagagtacaaaccctaaataaggaatatgagaagaacggcgaaaaagcgcaaagccgatatagagcaataaaagaaaaaatggcacaccaaaagcaaaataaggattcaacatgtttttttacctccttttatttatcatactccaaaatttacgttttgggaattacagtgtaagattaaaaggaaatagatttttaggaggatgttatgtcagcttatcttatgccaatcaaggttgcattactgttatttccattcttggcacttgcaatctcgtcgatattttttgtgcgccaataccgtaaatttggccgatttattttttcacgagcaattgtactttattcatttgttttttatctgctttgtgcctatttcttggtcattttgccgttgccgagtattgaagaagtcgctcaaatgaccggtcccaaaatggagtggcagttaggtgcttcctggcagcattttttgcagcaaacggtgttacaaatcaatgatcccactacgtatcttccggctttgaagcaaaacgtagtcttagagccattattcaatctttttttgacactgccttttggtgtctatatgcgctactactttaaattgtcttttccgaagacgattgtggcaacctttggcttatcactgttctttgaattgactcagttaactggattatactttatttatccgcgcccttatcggttgtttgacgtcaatgatttatttgtcaatacccttggcgggaccattggctttttggtgacgccattgttcaccttcctgttgcctacccgtgaagagatggatgccgaatcttatgccaaagataatcgagtgacgtttactcgccgatttgttgcttggctgatcgattggggaatattgaatttattcgcttggatgcttatgattctgttaagagtgactgtgaataaagaaatcgatgactttacgaatgattattggtattttttactagaagtagttctttactttattcttttgaattatattctcaatggacaaacgctaggaaaaaaacttgttcgcattcgagtgatggaggaaaatcattcccgtgtcagtttcagagcaatttttaagcgttatggattgctctatctgatctatgttagtgcgacacgcatcaatgtgttgtttacgccttttattcaatctactaatcaaatgctcgtcctagtgagtttgttggttgtgttgatttttggtttgatccaacttggattttattgcaacatcctttgggcagcattcaaaaaacaaccgcgattcttttacgaaaaaagaacggctacttatgtagtaagcacgatccagcgaaacaaggttaggaattgagctggaaatatgctataatccaaaagatgtcaatagaaagaaggtgtttgaatgtcttttgagtcatttaaatttcaaccatttatttacgaagcgttagcggagaagaaatttacttcaccaacagaagttcaagaaaaattaatccctgtgatccaaaaaggtcgcagtgtcgtgggacaatcccaaactggaagtgggaagacgcatacatttttgcttcctttgatggatcaaatcgatccgcaaaaagatgaagtgcaagtcgtgatcactgcaccgagtcgtgaattagccacgcagatttatcaagcggcaaaacaactagcagaatttcagcaaccagagattcgtgtgaccaactttgtaggcggcacggataaacaacgacaaatggaccgcttgcaaaaccagcagccgcagcttgttatcgggacaccgggacgaattctagatatgatcaatgaacaagcactggctgtgcatacggcacgagcctttgtcattgatgaagcagatatgacattagatatgggctttttggaagaagtggaccaaattgctagtcgattgccggaaaaactgcaaatgttagttttctctgcaacgattccagaaaagctgcgtccatttttgaaaaaatatctcgaaaatccattgatcgaagaaattcgtccgaaagcagtcatctctgaatccattgaaaattggttgatctcaactaaaggaaaagataagaatcaattggtttatcaactactaacgacgggacatccttatttggcgattgtttttgccaataccaaatcccgagtggatgaattaaccgactatctgaaagaaaaagggctgaaagtagccaagatccatggcgatatcacaccgcgagaacgcaaacgtgtgatgcgtcaggttcaaaatttagagtatcaatatgtagtcgcaactgatttagctgctcgcgggattgacatcgagggagtttcgcatgtaatcaatgctgagattccggcggatttggatttctttattcatcgtgtgggacgtactggacgtaatcagttagctggaacagcgatcactttgtatgatcctagtgacgaacaagccattcaagcaatcgaagatttaggtgtaaaattccaaccaaaagaaatcaaaaatggggagatcgttgcaacatatgatcggaatcgtcgacaaaaacgtgaaaaatcaagagacgaattagacccaacattgattgggttggtcaagaagaaaaagaaaaaaatcaagcctggctacaagaagaaaattcaatgggctgttgataagaaaaacaaagagaaacgaaagatcgaacgtcgtcagtcgaatcgctctgctcgcaagaataaaaaaaattccagtatctaatttaaggaacacccatcggccaggcaatggctattgggtgttccttcgttttagcaaagatttttttccatttttacacagaggattccatcttcttcaaaaggaggagagaggatctcatagccgcatttttgataaaagccgactgctgcaatttcagaagacaaaaccgaccagcaaaagccattggtgatcgctttttgctcataggccgctaacaactgccgtcctatcccttgctttcgatagtttttagccacgcaaaagcgatcgggctggatcgtttgcgaatccaacgattgatagcgaatagtggcaattggtacttggccttctgccagtagaaaataatggcagaactgatctttttgatcaaattctaattcaggagcgattccttgttcgtcgacaaagacagatcttctaagtgcaaaaacagcctgctgaatccagtcctcccgcccaaaataaagctgcatcatttttcctcccaattcatggtatactcaatctatattgattgtagcagatgaaaggggaaagctcgtggattttttcgaagcattgcaatggacgaattggaaaaatttgactgctgaagtcaaaagccaagtgtttcagcaagtagtcatgtactttgtcagcccattgaaagaaattacagatgttcattttattaaaacaagctatgcaggaatcaagtgtgagacctttgaattaacgattgatgaggaacccttcgtctttgtgcctggaaattatgaaacaattctaggctgggacttgggcattcagggattgccgataacctgctggtctaaaatgtggcaagaacctctcagcccttcgctccgtcgcttgatcaaaggctacggattgtcaaacgctgaggagtggggagattttgtaaatgaatcaatgagcccattacgcaaagcgaccatcccacccatgttggtgcagaaaatggcattgccagcaggtactcgtttgattggagaactagatacagtcacgggagaattccatggtcatgttgatcaatttgaaacttttggttccgagatacggcaggcatttcagcagccgcgaagttttgaagaaagtttgcagtgggaaatgccaagaacaatcagtgccgaaaatcagtactttgcggaactgtatccagtgtctggcaattatcatgtatacacccaccaacgaatgacccaaaatgaattgcagcactggctgggacagcagggatatgatttgatgaatgaagaacagtgggaatatgtagtgggcgccgggacccgtcgtttatttcgttggggcaatgaaaaaccctgtgaggatggtgtcaaattgaccaaaaaagcattggctgagccgaacatgtttggcttgatttatccgtatgccaatggatgggagttaactgacagttcatttctaaagatggaagattggccagagtgcggcaatccattactggatacattgccctatgctagttattatcggtcacgcaaaatgttgcaagcaaaccagcagttggaccctgaaaaataccgctaccgaaaagcagttattattgatcgagaacggatttgaggattgactttttgtgaacatttccttatacttttaaagacgaaggacatggttgatttgttcattctttacagaaagtttttcaaagctgagagaaaaacaagaatcctaattgatcgctccctttggtatctgattcagtagaaatgctgacgcctgctctgcgttatcgagtctgagaggtaatgatcaacatcattgcaagtaaggtggtaccgcgtagctacgtccttgctctgcagtggtgtttttttgtttgactacccagaagcgagttcgtcgaatgaacagatatcagagagaaaggtcaccaaagaacaaaagcattccttgctcccaagcgattttatcattagaaagtaggaaaactatatgaaacacttatcaagtgccgaagttcgtcaaatgtttctcgatttctttcaatcaaaaggacattcgatcgagcctagtgcatcactcgtccctgtaaatgacccaacattgttgtggatcaactcaggtgtagcaacattgaaaaaatattttgacggtaccgttgttccagaaaatccgcgaatcaccaatgcacaaaaatcgattcggaccaacgatatcgaaaatgttggtaagacagcacgtcaccacaccatgtttgaaatgttaggaaatttttcgattggtgattacttcaaaaatgaagcaatccattgggcgtgggagtttttgacttctccagaatggatggcctttgatccagaaaagctttatgtcacagtgtatccaaaagacacagaagcaaaacgaatttggcgcgaagaaatcgggttgactccagaacacatcgtagagatcgaagacaacttctgggatatcggtgctggaccttgtggaccagattcagagattttttatgaccgcggacctgagttcaacgatgtcgcagaagatgatccggagaattatcctggcggtgaaaatgaacgctatttggaaatttggaatttggtcttttcagagttcaatcatcaagcagatggcacgtatgaaccattaccacataaaaacattgatacggggatggggcttgaacggatggtgtcgatcatccaaaatgcaccaaccaactttgaaacagatctctttatgccgatcatcgaagcggttcaagaattgagcggcaattttgcatatggtgaaagcaaagcaacagatatttccttcaaagtgatcgccgaccacattcgcgcgctttcttttgctataggcgatggtgcactaccgtcaaacgaaggacgcggatacgtgttgcgccgtttgctacgccgcgccgtcatgcatggcaagaaattaggtatcgattcagcctttttatataaacttgttccgatcgtaggaaaaatcatggagagttattatccggaagtattggctcaacaagcgtttatcgaaaaagtaatccgtaatgaagaagaacggttccatgaaaccatcaatgaaggattagagatcttgaaccaagtcattgctaaagtgaaggcagatgggcaagagacattagcaggtgccgatatctttaagttgtatgatacttacggattccctgttgaattgactgaagaagtcgctcaagatgaagggttgaaagttgatcatgccggttttgaaaaagaaatggatgcacagcgggcacgggctcgttctgctcgatcgactgagctttctatgggtgttcaatccgctcttttgactgatatcaaagtcgaaagccgttttgttggctacgaaagccttgaagccaacagcgaattgttagtgatcattcaagaggaacaattgcttgatacagtaaccactggtgaagccaaactgatcttcaaagaaacaccattctatgcagaaatgggtggtcaagtagcggacactggtactgttgttgaccaatctggtgttatcgttgctgagatcactgatgtaaaaaaagcaccaaatggccagtttttgcatactgcgaaggtaactggcaacttgacggaaggggcttcttatttcttgcaagttgatcagcaccgtcggaacaaaatcatcaaaaaccacacagccactcatttattgcacaaagcgttgaaagaagtgctaggtagccatgcaaatcaagcaggttcattagttgcacctggacacttgcgttttgactttagtcattttggccaagtgactgcagacgaattaagtcagatggaacaaatcgtcaatcagaaaatttgggaagctttgccagtcgtaactatcgaaaccgacatcgatacggcgaagggcatgggggcgatggctctctttggcgaaaaatacggccaggatgtgcgtgtagtcaatgtcgcagattggtctatcgagctttgcggtggcacacatgtcgccaatacagaagatatcggtattttcaaaattgtttctgaatccgggattggtgctggcgttcgtcggattgaagcagtgacgagtcaagaagcttacgcattgctgcatgaaggagaagcacagctaaaagccattgcagggatcgtcaaatcggcacaaatcaaagatgtagtcagcaaaacagaacaattacagcaacaactgcgggatctgcaaaaagaaaatcaagcactggcgagcaaactagccaatcaacaagctggcgatgttttcaaagatgtcaaagaagtgaatgggattcgttttattgctgcaaaagtaactgtcaaagatatgaatcagttacgccaattggcagaccaatggaaacaaaaagaattatcggatgttttagttcttgctacagccaacgatggcaaagttaatctgttggctgcaatgacgccacaggcaaatgagaaaggcttgaaagctggagatttgatcaagcacatcgcaccgaaagtcggcggcggtggcggcggacgtccagatatggcacaagccggtgggaagcaaccagaaggaatcgacgctgcattgactgaagtagccaattggttagccgcaaactgattctttaacagcaaatcataaaaaaatgtataacatcaagaaatatccgaactggaattgtgtgtcagagagctgccgcgtctttttataagacgttcggtagaggatcgaaacgcgattccttcgggtattttttctgtttttgcagaaattggattttattaaagagaaattttggaatagctgaagcattcatttttagaaaaatacgttttttacatgcttttagttgttttactgatttcattcggggtaaaataagaaagacgaatttacgcttggagggaatgttatgctgcgcttctttttaaagcgaatgaaaggaaacgcaactgatcgcaccatgatcggtaaacttgcgggctatctgggattgctctcaaatgcacttctttttgtcgcaaagtttctgattggactgtcggcacaatcggtctcgatcatggcagatgctatcaatagtctgtctgacaccgcctcctcctttttgacattgatcggttttcggattgctgccaagccggcggatagggagcatccctacggccatgaacggtttgaatacattagcggttttgtggtttctttactgatcacatttgttggttttcagtttctaaaaaatgcctttgaaaaaatcattgctcctgaaccgatccgtttatcaccatggttgtttattgtgctgatcttgtcaataggattaaagctttggcaaggtctcatgtaccgtcaattggcgaagaaaattgactctgcaaccttacaagctagcggacaagatagttttaatgatgtactcacaacagttgcggtcttgctctctgcattgattgaatggggaaccggttggcgggtggatgggtatattggcttgctgatcgcgctatacattttatttagtggtatcatgatgatccgtacctttatcaatgaactgctaggtgcacgtccgacagaagctgaaatccgtgagatggaggatcgactagatcgttatccaacaatattggggtaccatgatctgctcgttcataactatggtcccaagaatcgttttgctagtgttcatattgaagtcaatgaaagctggagtttgtcacaagcccatgaagtaattgatgcgatcgaacatgattttcaaaggaaccttcaagttgaattggtttgtcatcttgatcctgtccctatccaaaataaacagtaccggcagttgcgggaaaaagtcagacaaatcgttgagacgattgatccagagttaaggatgcacgactttcggattcacgaaaaacagtttgcttttgatttggtgatcccaaagcaaagaaattacacagatcgtgaactgcaagataaaatttatcaaaagattacgcatgaaatcggcacgtatgaggtggcgatcacgtttgatcatacttatttgttgtaggaggaaaatatgataaaaatggatatgagtgtggtttcgaccgtctttttggcgttgctgtttgtcaatacagttgcggcatttattactgtctttcgtaaaccgcgatcaattgcaagtgtttttgcctggatgatgacattagtctttatcccgggttttgggtttttgttgtatttgttttgtggtcgaggaatcgacggagaaatcatttataaattcagtgagcaccatcaaagcaggatcaatgaattaaatcaaatcatcaaagtccacaattatttctttccagagcatccatactcagatgacaaccatctattggaacggtattttaaaaatttagatgaatcccctttgacaaaaggcaatcaggtacaattttatacggacggcaaggaaaaatttgctgccttattttcagatatgcaaaatgctgaagacaatattcatgtggaatactattctttttttaatgatgaaattggtgggcagtttcttgatgtcctaattgaaaaagccaagcaaggagtagaagttcgactaatattcgatccatggggttctcccaaagcaaatcgtaaattctttcagccattaatggacgctggcggaaaggtcgtgccctttattacttcaaaaaatttgattcgcaatacacgtttgaattaccatttgcatcgcaaaatcgtggtgattgatggccaaattggctggaccggcgggtttaatgtaggggatcaatatttaggtaaaaaagcaaaatttggttattggcgggatacacatgcgcgaatcgttggaactgctagttttaccttacaggaaatctttatccgcgattggaatgcctcgattagaaatgaagcagatcaactggaatatgaagatcgctatttcattttaccgcctaaagaagaggcaggtcatgtcgatatgcaaatcgtggccgacggacctgagacggaaacgcagattcttaaaggcggcttcgtcaagatgattttggcggctgaaaaatcgatttggatccaaaccccttatctgattcctgacgacagtatgatgaatgccttggagatcgccatccactcaggtgtagatgttcgaatcatgattccctgcatgccggatcatccatttatctatcgagcgacccaacactatgccaactatttacatcgccggggagcgaaaatctatatctatgagaatggatttttacatgccaaaactgttatgatggatgataccatctgctcgtttggaacgacaaatcaggacattcgcagttatgcgttgaattttgaagtcaatgcattcgtttatgatcaagaagtcacggcgcaattaaaaacgatttttgaagaggatatgctgcagtccactttattgacagatgaaatgctggctaaacaatcttactggttgcgtttcaagcaaaacttttctcgtttgttatcgccgatcttgtaattttaaagccttagctaacccttgacgggccagatggtcggcacctttgttttgagattcgggaatccattggacaattagtaaagtgaaatagggcagcaactcttggatttcctctaaatacttccgaaaatcggggttgttcgtatcatttttgtcgattgtttgagcgacgactttactgtctgtataaagcatgatcgtctggtcttgccattctttcgttaagagaaattcaagagcatgatgcatcgcagcaaattctgcttggtgatttgtgagcgtgggtagtacaaaggcatgctgttcatgcaggtcttcccctacaatcaacagaccgccgccactaggtccagggtttcctttggttgaagcatcgagatacacttttagcatgagttgactccttctgttatgatggatataagtatactagaaattgatcgcgtgaggaaattatttatgaaacgtaactatttttggcaaccagaaccagccaccgcaattatctattggtccagttcactgatcgttttgttttacagcttgattttggcactggaaaatactcgcccttattggaaaagcaatcttgtgttggggatttttctatttcttgtctggttaggattgcagcgccgcctttatttgacggagaagaccatcaaaatcacctatgcccgcttttggaaacgagtagttattcctctcgagaaaatccaagccattgggatagagaatcatcatttgagaatcgtgaccaatgaaagaagctatacgtttgtaatgcgtaaaaaagatcttgaagtattacagacacactttgttaatctagtgcctattcttgaaagacaagagtcagaaaaataattctggctctttttttattccagtgaaaaacagggtttcaatcttcatgaaaaacggtataatagaaataggacaaacaaatatgaaagaataagggataatagttcgggaatagagggttactgatgaaaaaagatatcgaaattgcacaagaagcaacaattaaaccgattattgacattgcagcaactatcggattacaagcagaagatctagaacaatatgggaagtataaagcaaaaatcgattggccagcaatcaaggaaatcgcgaaacgtcccaccggcaagttgatcttagttacagcgattaacccaacccctgcgggagaaggaaagtcgacagtcacgattggattggcagatggcttaaaccgtattggaaaacaaaccgtgattgctttacgagaaccatcattaggtccagtcatggggatcaagggtggtgcgactggcggaggcagagcgcaagtcttgccgatggaggacatcaatcttcattttaccggggacatgcacgcaatcactgctgcgaataatgcattatctgcgttggtggacaatcatatccaacaaggaaatgaattagggatcgacccgcgacggatcatttggaaacgtgtcgtggatttgaatgatcgcgcattaagacaagtgatcgtcggactgggcggaccactgcaaggagtacctagagaagatggctttgatatcaccgttgctagtgagattatggctattttgtgtctagcaacgaatttggataatttgaaagagcgattgagcaatattttgattggttatacgtatgataaacaacctatctacgtcaaggatttgcaggttcagggggcattagctttattgttgaaagatgccttgaaaccaaatttggttcaaaccatcgaaggaacgcctgcgttgattcatgggggaccttttgccaacatcgcccatggctgtaatagtgtcattgcaactgaaacagctctccatttaggagaatacacggttactgaagcggggttcggcgcagatctcggggcagagaagtttttggatattaaaacacccaatctctctaaagcaccagacgctgtcgtagtggtcgcaacgattcgcgccttaaaaatgcacggcgggatagataaagaacatttaaaagaagaaaatgtagcggctttagtcgcaggttttgccaacttgaaacgtcacgtgagaaacatgcaaaattatcaattgccagttgttgttgcaatcaatgaatttgtcactgataccgaagctgagatccaaatgttggagcaatgctgcaaggaaattggtgtaccaatcgctcggacgcaagtttgggagaaaggtggcgcagggggggaacttttggcgcagcaagtcgtcactgccattgatgaacaacccggcaattatcgtaggctttaccaaaatgaagagagccttcctgataaggctgccaagatcgtcaaagagatttatggcggatcaaatgtggtcttctcaagtgtggcacagcgccaattgaacgtcttcaaaaaaaatggctgggatcaattgccgatttgtatggcaaaaacacagtactcttttagtgatgatccgcagcttttaggcgcaccggctgatttttcgattacgatccgtgaatttgtaccaaaactaggcgctggttttattgttgccttgaccggtactgttatgacaatgcctggactgcctaagaaaccagcagcattgaatatggatgtcgatgcagacggcaatgtatctggccttttttaatcttattttctctccgcatctgcgaatactggatgaagaaataggttctcgaaggctccagtaatagttcagtcaatttcttataacgcaccacacttacaggtcactattgattctgtaagtgtggtgtgttgtttgcgagcgattcgtcgtctttcagtaggttttgtttggttcgttttttgttgacgctgtacataggctgcgagattcggaagagaataaaacctccctttttcttctgactttcaaaaattggaagaaataattgaagaggctgcgaggatatttgattttttgcgaagttttctaaaagtctcccatagttatctccagcattcctatttatccgtcgctcttagaaacattagaaacgaaagtaggaaacgggaaggggaaagtgttatcaagctcttttaaacgagagactataaaaagaatggttttaaaaagagggctataaaagtcgctcgtttttatcttatgatttgccgtttttgggttttcaatctattaaaagactgaaagttaaatattagcaagaggcaagagacgtgtcttttgttataatataatcagtagtgcatttaaaagactgttttctttctaagaaaattaaagtatactgataaaattggagcgtataaaacgatgaaacgtaaaatcatacgaaataccggcttttatgcaatggggagtccgctggatttgctagtggatggtcagaaagtcgccagaatcaatcatcaagaaaccgtcgagctgaatctcaattctgacaaccgattgtctgtccgattttccatcctaaaaagcaaagaaattgcgttgcctgatttacacgcagaaactccattagaaataaaaatgaatccgcgactgatttctttttatgtgctgttttatattggtctgtttctaatgatcgcgtttttaactcgcagtggacagttgtccattatcctttcgggtatctttctttatttagcaggttatctatgtttaggtctttattatagcaaacaagcgtatgtaattgaggaggcaacaaatggctagcggagcagatatttttttgagtagtttcaatcgaatcgaaaaacaattgagagacgatttgggtaatcctcgtaacatgggtttttcagagatggttcgccgtctttcaaaacagaagcaaggagacatcaaaaaatacgaagaagatttattgcagatggcccaattgcggaacgccatcgttcatgaaaaaatcggtgaaaattttgtgatcgccgagccaaatcaatgggtagtgacacgaatccaacaaatcgaacaggccttgttgcagcctgaaacggtcttacctaagtttggtaaaaaagtgaccggttttgaaaaaacgttggcgctgaaagaaatcttgaagatcgtcgctcaaaagcggttttcacaatttccactctatgacaaaggacgttttgttgggttgatcactttacgtatgttaggatactggtttgctcaagaaagtctaaaaggagagatccgattagaagggcgtaaagcagaagacttgttgatcaaagacggtaaagagtccaattatcagtttgtacccgcaacaacaacggtcactgaagtagaagacctgttccataaaaatgctttacttgaagcggtattaatcacaaaaaatggcgatcctaatggaaatttattaggcatcgttcgtccgcgggatatttttaacgaagaaagtgtggaaaaaaaatgatagctttgttttttttactaagtgccataattgttggacttgatcagtggttgaagttttggatcgtcagcaattttgaattaggtgatgttcaaacgttgatcgaccatgtcttttcactaacttatattcggaataccggtgccgcatggagtatcttagaagggaagatgaccttctttacgatcatcacggttgctgctgttattgttgtaacttatttattgatccgtcatcgtaaaagcagtatatggtttcgattgggactatcctttatcttagccggagcgatcggaaattttatcgatcgcttgcgtttggggtacgtcgtggatatgtttcagctagattttatcaattttccgatttttaatattgcagacatgtcgttagtgatcggcgtgttattgatttttatctatgcgttagttgatgatgaagtgaagggaaaataaatgaataatcaaattgaagtagtaatccatgaagaaaaagggcgtgtcgataaagtattggcagatcgtctagaagcgagccgttcgcaaattcaacaatggttgaaagaaggtgcggtcacctgtcaaggggatccaattcgtgcaaattacaaagtaaaagctggtgaccagttagtgattcaagtaccagaaccagagtccctagatctggaacctgaagatattcctttgacgattgtgtatcaagaccaagatgttgccgtgatcaataaaccgcaaggaatggtcgttcatccttcggcagggcatcctaacggaacgctggtcaatgcattgttgtatcatatgatcgatttatcttcgatcaatgatgttgtacgaccaggaattgttcatcgtatcgacaaggatacgtcagggctattgatgattgccaaaaatgatcatgcccatgaagcgttagccaaacagttgaaagacaaaacttctttacggaagtatgttgcgctggtccatgggaatatttctcacgaaaaaggcacgatcaatgcaccgattggccgttctaaagtgaatcgcaagatgcaagcagtgcaagaagatggtaagccggctgtgacacattttacagttttggaacgttttgatcaatttactttagtcgaattacagttggaaacgggtcggacccatcaaattcgggtccacatgcaatacattggctttccattagccggcgatcctgtatatggccctaaaaagactttgaaaggcaatggccaattccttcacgccaaactgttaggatttacccatccgacaactggagaatcaatggtttttgaagcgccattacccgaactttttgaggaaaccttaaaaaaattgcgaaaaaatgattgatttttttttcaaagaactgtatagtgtgtgtaacaaataaatagctcctttaagtgtagtcccgtgaggctaagaaggaaatgagcaagcagacgactcccgcgttggagcatcgaaaacttgctggatgattgcgcatattctggatcgctgtatacagcgccagaaagtatgatcggaaaacataactcctgcctcactaggcaggagtttttttatgttcaaaattaggagggaacgaaatgccaaccaaagaagtagtagatgcagtaacaatgaaacgagcattgaccagaatcacttatgaaatcatcgaacgcaaccgagggattgatgacctagtcttagtaggaatcaagactaggggaatctatatcgcacaacgaattgctgaacgcttgaaacaattggaaggggtagaagtccccgttggcgaactggatatcacattgtatcgagacgataaaaaatcagatgaagatcctgagatccattcttctgacattccaacagcaatcgatggcaaagaagtcatcttgatcgatgatgtgttgtttacagggcgcaccatccgggcagcattagatgccatcatggatttcggtcgtcctcgccggatttcactagccgtactagtcgatcgggggcatcgagaattaccgattcgggcagattttgtagggaaaaatattccaacggcattaagcgaacaaatcattgttgaaatggaagaatctgacggttctgatcgaatcatgatcaataaagaaaacgagtaggaagaagagtgacagacacatggaaaagcaagaatttcgcaataccgatgtggtattagatatcaatgatcgcccaaaggcattgccttggttaggcttaagtcttcaacatttattcacgatgttcggagcaactgttttagtaccgatcctagttgggatcaacccaagtatcgctttagtaagttccggtttggggacacttgtttacctcgttacgacgaaaggaaagattcccgcatacttagggagcagctttgcttttatcgctgcaatgcaaatgttgatgaaatcagacggctacccggcaatcgcccaaggagctgttacaacaggactggtttacatcatcgtttctctgatcatcaaaaagattggtgctgcatggctggataaaattttgccgccgatcgtcgtagggcctgtgatcatggttatcgggttaggactagctgctaatgccgctcaaaacgcaatgtacaatggggacatctatgattttaaatttatcttagttgcattggttacattgggattgacgattttcttcaacatgtttttgcgagggtttcttggcttgatccccatcttactagggatcattggtggttacttagtagctttagctgctgggatcgtagatgtgcagccaatcattgatgctgcttggttctcattaccaagcttcgaaattccctttgttcaatacaagccaacgctacatttgaatgcgatcacgacgatggcgcctatcgcttttgtcacgatgacagaacatattggccatttgatggttttgaataaactaacaaagcgtaacttttttgaagaaccaggattaaacaaaacattgatgggagacggctttgcgcaaatcgttgccggattcgttggaggaccccctgtgacaagttatggtgaaaacattggtgtcttggccattacgagagtgcacagtgtctttgttatcggtggtgcggctgtcttggctgtcttgttaggctttgtcggaaaattgagtgccttgatcttgagtatcccaaatccggtcatttctggaatcagcttcctattgttcggtgtcattgctgcaagcgggatgaaaatcttgatcgacaataaaatcaattttgaccgcaaaaagaatttgatcattgcttctgtgattctggtgatcggaatcggcggccttgtctttacggtcggaacattcaccttatcagccatggcattagcaactgtcttaggaatcattttaaatctaattttgccagaaacatcacgcagtgaagaacaataactagtcgtcaactaaaagggaaaaactaggaggtattattcatgatcatccaatcagaaagaatcagtttaaagcatcttttgaccgttgaagcattaacagatcgagaagtgatggggcttatccgcagagggcaggaatttaaaagaggggccaaatggatgccgcaaaaagaacaatactttgctacgaaccttttctttgaaaatagtaccagaacccacaaaagttttgatgtagccgaaaagaaattaggtcttgaagtgattgaatttgactcctcaacgagttctgtgcaaaagggcgaaaccctttatgataccgtgctgacaatgtcagcccttggcgtggatgtcgctgtgatccgccacggggatgaaaattattatgacgagctgatccaaagtaaaacgatccaatgcagcatcatcaatggaggcgatggcagcggacagcatcccacgcaatgcttattagacttgatgacgatctatgaagaatttggccactttgatcaactgaaagtagcgatcgtcggagacatcacccattcccgtgtcgccaaatcaaatatgcaaatgctcaaacgattaggcgccaaagtgtatttttctggcccgccacaatggtatgacaatgaatttgaagtgtatggacactggttgcctctagatgaattagtgaatcaagtcgatgtgatgatgatgcttcgggtccaacacgaacgccatgatggctcagaaagtttctcaaaagaggcttacttacgggattatggattgacagtggaacgtgcagcaaaaatgcaagaccatgccatcatcatgcatccagctccagtcaatcgtgatgttgagctggcagatccattagttgaagggctgcgttcaagaattgtcacgcaaatgacgaatggcgtgtttgtccggatggcaattttagaagcggtattgaatggcaaagcttaattataagaaacgcgaccaatagagatagaggaggaagcaacatgaaaacactcattaagaacggtaagatcatcgctgacggtgatcattgtatccctgcagaaatttggatcgaagatggtatcatccaagcgatcggaacgactttttcagaaacagggttcgatcaagtgatcgatgcaaagcaacaactgatcactccaggattagtggatgttcatgttcacttcagagagccaggatttgaatacaaagaaacgatcaaaacaggaagtatggcagccgctcgtggcggtttcactacggtttgtgccatgccaaatttaaatcctgtgccagataccgcagaaaaattgcaacaagtctaccagcgtatccaagaagacgccgtggttcatgttttgcagtatgcaccgatcacagaagaattacgtagtgaagttttaacggatcaaaaagcattgaaagaagccggcgcttttgcattcaccaatgatggcgttggcgtccaaactgctggtacgatgtacttggcgatgaaagaagcggccaaaaaccaaatggcattagtggcgcatacagaagatgactctctgttatttggcggtgtgatgcatgcgggtaagagagcagcagaattaggcttgccggggattcttagtgccacagaagcatcacaaattgcccgggatgtactgctggcagaagaaaccggggcccattaccatgtctgccatgtttcgacaaaagaaagtgtgcgggtcatacgtgaagccaaacaagcaggaatccatgtgacggcagaagtttccccccatcacttgcttttgatcgatgaagatatccctggcgatgaaggattttggaaaatgaatccgccgcttagaggtagagcagatcgcgaggcattgatcgaaggattactggatgggacgatcgattgtatcgcaacagaccacgcgccacatggctatgacgaaaaaatgcaaagttttttaaaagcaccatttggaatcgtcggttcagaatatgcttttcaattgatttatacgcattttgtcaaaacgggccgctttacactccaacaagcggtggcttggatgaccgagaagcctgctgaaatctttggattgaaagctggcagattaatggtgggagctccggcagatctcgcgatttttgatctagagacatcttatactgtcgattcggatcaattcctttcaaaaggaaaaaacacaccatttaataactggccattatatggggataccacccatacattggtcaatggaaaattagtttggcaaaaaggtagggggattttatgaaacgctggttgattttggaagatggcacattatttgaaggtgagggatttggcgcagagatcaatgtctatggcgagattgtctttaccactagtatgacagggtatcaagaaaccattacggatcaaagtttcaacggtcagatcatcacctttacctacccaatggtgggaaattacggtgttaatcgcgatgactatgaatcaatcgctcccacttgtaaaggtgttgtagtgaaagaacatgctcgtgtagccagcaactggcggaaacaattgaccttagacgaatttctaaagcgcaaaaacattccgggaatcgcaggaatcgatactcgggctttgactcgtaaaatccgccaatttggaacgatgaaagctagtattgtggatgccaatgatgaatttgctcatgcctttgatcaattgaaagcagccgttttgcccaccaatcaagtggcacaagtttcaacttcaaagccttatccaagtccaggaacaggacggaatatcgtcgtgatcgattttggcttgaaacacagcattctaagagaactttctcaacgaaattgtaatctgacgattttaccctacaataccaccgcacaggaaattttggatctcgcgccagatggtgtcatgctgaccaacggacctggtgatccgaaaagcctccctgaagccatcaaaatgattcaagaaatccaaggaaaagtaccgattttcggtatctgtttaggacatcagttgtttgctttagctaatggcgctgatacttacaaaatgaaattcggtcaccgaggattgaaccatcccgttcgagaaatcgctacaggaagaattgatttcacctcacaaaatcacggttttgcagtagcagaagcatcgattgatcaagagaaactgatcatcactcatgtggaagtcaatgatggaaccattgaaggtgtccgtcatcgtcgctacccagcatttagtgttcagtatcatccagatgctgcaccgggacctcatgatggcgtacatttgtttgatgaatttttagaaatgatcgatgcatggaaggagcagaactaaatgccaaaacgtacagatattaagaaaatcatggttatcggttctggaccgatcattattggccaagcagccgaatttgactatgcaggaacgcaagcctgcttagcgttgcgagaagaaggctatgaagttgtgctggtcaactcgaaccctgcaacgatcatgactgataaagaaattgccgacaaagtctatattgagccaatcactttcgaatttgtctcccggattttaaggaaagaacgtccggatgcgatcttgccaacattaggcggtcaaaccggcttgaatatggcaatggaattagccaattccggcatcttggatgagttggaaatcgagttgttaggaaccaaattagctgcgattgatcaagcagaagaccgtgatctattcaagcaattaatggaagagttaaatcaaccgattcctgaatcggagatcgtttcaacagtggaagaagcagttacttttgcaactaagattgggtatccaatcatcgttcgtccagcctttacccttggcggtactggaggcggtatgtgtaataatgaagaggaattgcgagtgattgctgagaatggtctaaaactgtcaccagtgacgcaatgtctgatcgaacgcagtattgccggctataaggaaatcgaatatgaagtcatgcgggattcagccgataatgcgatcgttgtctgcaacatggaaaactttgatcctgtcgggatccatacaggtgattcgatcgtttttgcaccgagtcaaacactctccgatcatgagtaccaaatgttgcgtgatgcttctctaaaaatcattcgcgcattgaaaatcgagggcggttgtaatgttcaattagcgcttgatccccacagctttaattactatgtgatcgaagtcaatccccgggtttcccgttcgtctgctttagcaagtaaagcaactggctatccgattgcgaagctagcagcaaagattgctgttgggttgacattagatgaaatgaaaaaccctgtcacagaaacaacttatgccgagtttgaaccggcattggattacgtggtagccaaaatccctcgttggccctttgacaaatttgagtccggcgaacgccgtttaggtacacagatgaaagcaaccggtgaagtgatggctatcggtcggaatatcgaggaatctttgctgaaggctgtgcgttcattggagatcggcacacatcatattgaaatgaaagaattagaacagctttcagacaatgacttgatcgataaggtgatcaaagcgcaagatgatcgcttattttatgtcatggaagccattcgccgcggctatgctattgaagaattgaatgaaatgactaaaatcgatcttttcttcttggataaaatgctgcacatttatgaaatcgaacaagaacttgctgccaacagccaagattttacaacattaaaacgagcgaagcaaaacggctttaccgataaaaaaattgctgagttatggcagatgacagaacaagagattcgagacatccgtaaggaaaatcagttgcttcccgtctacaaaatggtagacacttgtgctgccgagtttgagtcggcaacgccttacttttatagtacgtatgagtttgagaacgagagtgttcgcagtgaaaaagaatctgttttagtcttaggttctgggccgatccgcatcggtcaaggtgtggaattcgattatgcaacagtacactcggtcaaagcaattcaggctgcgggctatgaagccattattatgaacagcaatccggaaaccgtttcgacagacttctcgatttccgataaattgtattttgagccattgacactagaagacgtcttgcatgtgatcgaactggaacaaccaattggggtcattgttcaatttggcggtcaaacagcgatcaatttggcggagccattagttgccgcaggagtcagcatcttaggtacgagtatcgaagacctcgatcgtgctgaaaaccgtgatctctttgaacaagcgttacagacattagctattccacaacccccaggagatactgctacaaataccacggaagcagtggcgatcgctaatcgcatcggttatccggtccttgttcgtccgagttatgtcttaggtggtcgggcaatggaaatcgttgaaaaccaagcggatctggaagattatatgaagcatgcagtaaaagcttctcccgaacatcctgttttagtcgatcggtacttagtagggaaagaatgtgaagttgacgcaatttgtgatggcacgacggttctgattccggggatcatggaacatatcgaacgagcaggggtccactcaggtgactcgatggcagtctatccaccgcaaaacctttctgacgcaacgattgccaccatcgaagactatacgaaacggttagcattgggattgaattgtgttggaatgatgaatattcaatttgttatccacgaggaaaaagtttacgtcattgaagtcaatcctcgggccagccgaaccgttccatttttgagcaaggtcacagagattcctatggcacagatcgcgacaaaagcgattttaggagaaaaattggcggatctgggctaccgtgatggcctttatccaacaccaaacgaagttcatatcaaagcaccggtcttttctttcaccaagttacaaaaagtcgatacttacttaggtccggaaatgaaatcaaccggtgaagtcatgggttcagacaaaaacttagaaaaagctttatataaagcttttgaagcagctggtttgcatattccggaattcgggaaagttctttttaccgtagcggatgaaagcaaagcagaggccgccgtgttggctgcgcgctttttcgaaatcggcttctcgatcttagcgacaaaaggaacagccgattactttgaaggctatggcttgccagtcacccgggtagcgaaaatctcggaaacagaagatgaaactgtcgttgatctcatcagaaaaggcgtgacccaagtggtgatcaatacaatggacaaaaatcggcaaaaagccactgaagacggatttattattcgccgggaagcagtcgagcatggggtgccgctcttcacctcgttagacaccgctgatgccattcttcaagtaatggaatcaagaggtttttcaacgaaagcaatctagcagtcagaaaggaaaacagctcatgaaacaagaacgaatgaccattacaaaacagcgaatgctcgcaccgcgaatctacgagatgactctctctggtgctctcgttcaagaaatgaccacaccgggacaatttctgcatattcgagtgccggatgatgcctttctcttaagacgaccaatcagtattagctggatcgatcaagaaagccaaagttgtcgcatcatttatcggacagaaggggaggggaccaagcggtttgcccatctgcaaagcgggaatcaactggatgttttaggccctctagggaatggctttcatatcgaagatttacaaaaagatgagactgtttttatcgtaggtggtggtatcggagttccgccactctacgaactttccaaacaattagtcgcaaaaggtgtacgcacgattcattttttgggatttgctagttcggaagtcatgtattacgaaaaggcgtttcaagctctaggggatacacgaatcgcaacggatgatggcacctatggcgttcaagggaatgtcggtaatctattgttagcagccgatagcaaacctgcggctgtttttgcctgcggcaacaatgggttgttaaaaacggttgaacaacttttccaagactgtccgaatgtgcaactttcattggaatctcgcatggcttgcgggatcggtgcttgctatgcttgtgtttgtcataaagccgatgatccaacagggaccaaaagtgtcaaagtctgtgacgaaggccctgtttttcaagctggaaaggtggttatttaagtggttttagctgttgaattaccggggttgtctctcaaaaaccccataatgccggctagtggctgttttggttttggcgcagaatacaacaagtattatgatatcagtcagctcggtgccgtcatgatcaaagccacgaccccagaagcacgctttggcaatccaacaccgcgagtggctgaaacaccaagcggcatgttgaatgcgattggcttacaaaatcctggccttcgagtagtcatggaagacattttgccagagttagcgcaaaagcatccagatctgccgatcatcgcaaacgtggctggttccactcaagaagattatgtcactgtctgtcaaaaaatcagtcaagcgccgaatgtaaaagccattgaattaaatgtttcctgcccaaacgtcaaacatggtggtattacttttggtaccgatcctcaagtggtgaaagaactgacccaagcggtcaaagcagtttcgcaagtgccaatctatgtcaaactatcgccaaatgtcaccgatatcgtacccattgcaaaagcaatcgaggcggggggtgccgatggtttcacgatgatcaatacgttattgggtatgcgcattgatttgaagacacgacgtcctattttggccaaccagaccggggggctctcaggcccagccatcaagccagtcgcgattcgtttgatcaaacaagtggcacaagtttctttgttgccaatcattggcatgggcggtgtgatgacggttgatgatgtgttagaaatgtatttagctggagcgagtgcggtagcagttggtaccgcaaattttactgatccttatatttgtcccaagttgatcgaagaattgcctgtacgaatggcagaattaggtatcgactctttggcacagttgatcaaggaagtaagagaggggcattaagatgattgaacgaccaattattgctttggattttccaagcaaaaaagaaattgagctttttttagagaaatttcctaaaacagaaaaattattcgtcaaagtcggtatggaaatcttttatcaagaaggaccagaaatcgtcagctggttaaaagatttaggccatgatattttcttagacttaaaacttcacgacattcccaatactgttgagcgggccatgacacgtttggcaaatcttggggtcgcgatcaccaatgttcatgcggcgggtggtattgagatgatgatagcagcaaagcggggactgcaaaatggaaccaaggaaggccaaactgtgccgctattgattgctgtcacacagctgacttctactagcgaagaacaaatgcagcaagaacagctaatttctgtttctttagaagaaagcgtgcgtcattatgctcaatgtgcagaaaaagcaggattagctggcgtggtttgttccgcccaagaagctgctgccatcaaggtagctaccaatcctgaatttatgtgcttaaccccaggaattcgtccggctggtagtgatgccggagatcaaaaacgaatcgtcacaccagcaaaagcaagacaaattggttcttctgcgattgttgtcggtcgaccaatcacacaatctgcaacaccttttgatacttaccaggaaattaaacaagcatggaaggaagctattcaatgacagaaatcagtaaagcaattgccaaagaccttttaacgattgaagcagtatttttacgtccaaatgaaccctttacttgggcaagcggcatcaaaagcccgatttattgtgataatcgtatgacaatgagttaccctgctgtacgtaaagcgattgccagtggtttggctgcgcaaatcaaagaacactttccagacgtcgaagtaattgcgggtacagctactgctgggatccctcatgccgcttgggtagcagatattcttgatttgccaatggtctatatccgcagcaaagccaaagatcatggcaaaggaaaccaaatcgaaggacgtatcacggaaggtcagaaaatggttgtgatcgaagatttgatctctactggcggcagtgtgttagaagcttgcgaagcagccgctcgcgaaggggcaaatgttctgggggtggcagcgatctttacctatgaattgccgcagggattaaccaactttgaaaaggcccagctgccattagtgacgttgaccaactattcaacaatgatcgatactgcattagagatggactatatcggaaaagaagatattgcattgctgcagcaatggaaacagtcacctcaaacttggactggtaaataagaacaacgaatatgcctggagtgatccaagagcatattcgttttatttttatcttttttctgatacgatttgagacgattcatcaaaagttatctggcagttgaaaggcagccagtttcaatagggaggcagttttattgaaaagaaatatggatgttccatggagttattctggggagaatggtcctgagtattggcacacattgtgtgactggtatgctgaaggagcgaagtttccattgcaatcgcccattgcgctttaccatgacgatacagaggaacctgtcgatgaggatttaagcttccattaccatcgggaacgctttactgaaaaagaatttaaaaatacgattcattttgttccatataataaagaaagttacgtgacctttcaaggcatcaattactacctaacggatattcattttcatatgccttctgagcatatcatcgatgatgagcagcaagaacttgaatttcatttggtacatatgaatgaacaaggagaaaacttagtcgtcggtattttgttccggttaacagataaattaaactggatctgtaatcagcaagatgatagtatttgggatttcaaaaaccatacccaatggtttgacccatcgatgtttttaccggaaatgacccaccattttcactatgtaggttctttgacaactcctccaactaaaggtccaatcaactggtttgtatttgactgggtaggcgagatgagtcgtcgctttattctggaatttcgtgaagaagttttggaaaacaataatcgtccattgcaggatcgaaaagaccgaccaatctacttttactgatggtctagcgaacgaaaggaaggttacgaaatggatcagtttcaagagtacctaacaaaagaattgtcagaggcacagcgaaaagtcctggagccattatttgaacatatattaactgaattcccggatttgcagactcgaattgcttggaaccagccgatgtttacggatcatggaaccttcatcttggggattagcagttcgaagaaacatttctcagtctcgccagaagtgaaaacgatggccttgttcaatacccgcattgaagcaagtggctattcacaaacaaaaaacatttttcgtattttatgggatcagccggttgacgaaaagctgatcttcgacattatccgttttaatatgaaagacaaagcggattgtcaaaccttttggcgctagatagtcgttctgaaaataaattttaatggccaacaaaaaagacgatttattcgtcttttttgttggtttaaatccgggatcatcagacaatagcgaccgaattatgctaaaatagtggaaaatacacgaaaatccttttaaaaataccaactattgtgaacgaaagtacaattgaatcttttttaggaaaaagagcagagtccgttaagcttttttcttttagttgttttatagtgtgagaaaggagacttctatgcatgcatgggaagccatacagaaaacattggaccatattgaagcaaatttagctgagacaatcgaaattgatgagttagccaaagttgctgctttgtcgccgttttattatcagcgtttattcacgcgattagtcaaatcctcagtcagagagtatatcaagttacgccgtttggctgtagcagccacctatttacaaaaacagcaacggcgaatcattgatgttgcgctggaggttggattcaataatcctatttctttttcgcgatcgtttaaagaagtttatggcatttcaccctcacactatcagaaacagttgctcccattacaaaatttcgataaaccagatttatcccttagccatattgcggtagaggaaggggaaccgttgatcagtgaaggagtcgtcttagcaatacagcagaaaataatggatcagccgcgggttttcaatggtatcgttggttattatcctttcaagtatggcaaaatgctaggagaaagaaccggcgtagatccagctgaaaagatttggcaagacttttttcacgcttgtgccaatcatccatttttgcgagcagagacgctcattggtgtttcctatcctggagaggcaccagcaggtcattccagttattttgtcggggcagaatctgtcactggaagatatgagaaagacatgagccatctgacaagctggacattaccggcccgtgactatgttgtttgcagctttgagacgactaaagcacaaatgatcgtcgggatgggtaaggcaatgaggtatactcgtttttggctaaaaaaacacggtttgatagcggatggcttttttcctgagctttatcgacaatcgcaagcggagatcatgattgtcgaattatggattccttttaaaacaagagaaaattttcaaggaggaaaaacaaatgatgaattatgaagagggcctgacattactggaagaaaagtttggtaacgacaaagacaatttgatctctttagcaacgattgcgcgcaattgcggtgaaaatgggttgcctcgtcctatggtgcgggatgtagatgcttattatgagaatggtgtcttttatgtatcgacccatgaaagctccaacaaaatccagcaaatcaaagaaaatcccgaagtttctatcgcagtctgtggcgaatggtttaccgctaatggcatcggagaaaatctaggatgggtcttggacccaaaaaatgcggaattgagaaaaaaaattcgcaaggcgtttgtttggtacgatgaagttaatgatgaagcggatcaaggctgttgttttcttgccattcggttaacgaaagggacattgaatatcaatcactgggaaaagctctatcattttgattttgaaaataagcgcatgattgatcaaaatgatactttttaaccaccaacaatgcatcgattccattgatcagtcatctggactagcgttgtttcgatgaaatggcttggctgatgtgtccgagagcttcttagcgtttccaagtatttttccataaaaaatgagccgcttacggatttgttctatccacccattctcagcgattgacgagaaggctgtgtgttagagacatgtaagcgggtcatttttttaattcttcgccaacttttttggaaaatcagcaaaagaacagcgttagttttgttttaaatccaaaattgtttcctcaggtgttacataataagtcgtctggttctcataaatcacaaagcctggttttgcaccatttggtttgcgaatatgtttgacttgtaccaaatccacaggtacttgtgcggagtggcggtatttcgagaagtaggcagctaattctgcagcttccaagattgtttcttcgctaggtgaatccgaccgaatgatcacatgagacccggggatatttttcgtatggagccaataatctgttttacgtgccgtttttaaagttaactgatcattttgcagattgtttttgcctaccagaatctccgttccatcagaagagagaaaacgttccggttgcgagggcgtttgttttttccgttgtttcgtccgatttttgacatatccttgggcagcaagttcttcgcgaatcgtcaaaagatctttcggtgcggcaatttccaactgtgcttctactgattccaaataggcgatctcatcttttgtttcagcaatttgctgatgaatcagtttgacagcatttttcagcttttgataacgctggaaatatttttgcgcgttctggttgggtgtcaaggccggatctaaggcaatttttattggtttgttctcatcatagtaattagctaattccacttcgcctgcaccgcgagggacttgcgccatgaaagtcgttaaaagctcgcctttttgacggaattcttccgcattctcagattctcgcaaagtttgctgtcttttttctagcttgtgcttgtttcgcttcagctcattgtcgatttttttcagcaattcactgccttgctgttttactcggtcacggtcagctttttcatgataaaacgcatcaagcaatgcgcttagactctggtaagtttcctgccagtccgcttgttccatcagtgaatgaaaggggaccggagtaaagaattctttgttcccggattttaagtaggtaggaacaggatccgctagctcggcaaaaaattcttcccaaacggttactttttcatttggtcgttctttcagacgagataccagctcatctgccgtatccctgccaaatccttgaaaagtctgctgcaagactttgggcgacaattcttctagacgagacagcatttcaaagacttttgtttgattgagtgtatacggatcaacagtgtcttgttttggcggagcaacataaagggaccctggcagcaaggtacgatacgtattttgcgaatggccaatgtgcttgatcgtatcaacgattttaccggttgcccgattcattaagagaatcgtgctgtgtctgcccatcaattcaacgatcaaaacaaagttttgtaaatcgcctaattcgtcacgacgagtaaaatggaaatgaacgactcgatcattcgcaacttgttcaatcgtttccaggattgcgccatctaaatacttccgtaacatcatcaaaaatgttggaggtgtttctgggttggtataggtagcttgtgtacattgaatccgagcatagctcggatgggcagatagcaataatttgtgatttttcccttgagaacggatcacgaagatcacttcgttctcataaggctggtgaattttattcactcgaccattaacgagttcattttgtaattcctgaaccatcaagtgggtaaagatgccatcgaaggacatttgtttccctcatttctgttttatcaaacttttttctcattcaatttttgaggtcaagacatttgaccgataaaggcaagtaaaattaacgaatccagattgaatcgagtagttctattataacgaaaagaaaccagaaagaccaatcctgatccaagcaggacataccccatcagatttaggatatattgaagcattcactaagagtccgttttattgttttgtgcatcctttagggctttttcaatctccatattcaagaaataggaaatgactgttcgaatgactacgactactgctaagcggacgatatcggcaaatgtcggatggatgatggtctcaatgatatctgcagcaatcaagatctccaaaccaagcaaaacataactgccgagaaaatttcgaataaaattgttttctctggccgcactcatacggtctttcgcttttatttcaaaacgaataaaatcaaaaccagcttttacaactccccacacaagcactaaaattgaaagcagattcagacaaacgacgattaaatctaaaatggggattgcattatccattaaaagttcagcaagatcagccatgactaactcctttggttttttctctatcttatcgaattttacttaatatgggaagttatatgggaagtttcttgacgctccaaagacatcttgctagtataaagataagttgatggcagatgaaaagggcggggtttaggatggagcgattcgagaatttttttcagttggtaaaagtgaagatgcgagaaagctgggaagcttttgtccaaagtgtctaccaaaatcagcgtaagaccatgtattatttaggtacaggtattctacttgctgtgctatttgctgtagtgattattacttctcaaacgaggatcaaaacatcgctgatccacaagatggcttttgaagaattgccttctgataagatcgaaccattagaatatgcagaagcagatcaaacgattcgggacacaaaagccatttcggtgatgtttagtaaaccgaatggcgaagagttggcagaagtgtttcaattgtttaatgataaagagagtgaaatgaatcgatccgtgtactattatccgatcgtatatgatacacagtcttttttagatacttacggtgtaaaagcaaatgaaatcacctttgttttctttgaaaacgggcaagagaaaaatcggtttacttatcaatcacttaaagatcctgcagaagaatttattcctgaattgaatcggttaccaatgtggaatattcgcaaattagcagagtaagaaaaaatctgacaatttgaataaaagttattgacgttcttttattaatacgctaaactaagtgaaacaaagttaaacaaatggaaaaaggaggagctaatatgagactattttacgcattgcaatcaaattcatggcaaaactggcgtagatagttgtattggtggacctcaatccatagatacaactttttagagaaccttctaaagtgctgtatctatgctggtaaatgaatctttcaccgcatagaacgattagtctatgcggtttttgcttgaagcaactgccggattgtcggcagttgctttttttagttctcaagtatcaacaaaaaaatgagaaagaagcgaggagagttaaaaatgaaaaacaaaggattaattgctgcagttattgttatttttggatttttattggcggcttttgggtaccaaatgggagcaaaacaaacaggagaatccgctgaacaaccgacggatcaaacagcaaaaaaagaacacaaaacggtgggtattctgcaatttgtcagtcatgaagcgctcgacgaaatcactcgaggcgtcaaagaagggttaaaacaatcgggttataccgaaggggataatttaacaatcgaatttcaaaatggccaagcggatcaaagtaaattagcgaccatgagtcagcaattgctgaacaaaggcgctgatgtattagtagggatagcaacacctgctgctcaagcattggctaatactactaaggatgtgccaatcgttttaggcgcggtgaccgatccggttggggccaatctagtagctgatatggataaacctggaggaaatatcactggagtatcagataaaacaccagtagctactcagtttgaattagcccaagaattgatgccagaggcaaaatcagttggtatcttatattcttcaacagaggataactccaagtatcaagcagcagaagcagaagcggccgcagaaaaatatggcttgacgtcaaaaaaatatgcagttccttcaagcaatgaaattgctcagacggtacaggtgatggcagaaaccgtcgatttcatttttatcccattggataatacgattgccaatgcgatgcagacggttgtcggagaagcaaacaaaacgaaaacaccaatcatcacctctgcagaaaccatggtgcaacaaggtggcttggcgactgtgggtcaaaatcagtttagcttaggtgtccaatcaggtaaaatggcagctgcgatcttaaaaggggaatctgatccagcaacaacccccatctatacttttaaagatggcgatacggtcattaatgaaaagcaagctgaatttcttggcatcactattccagaagcactcaaagaaaaagccagactcatttctgacgaagcgaccgaaacaacatcaagcacagactaaccattgaaacagctgctcttaaaagggttatagcaatgctaactaacgtttcataaagaaacaagaaaaaaatctattgcttttaaggaatatgtgtcctgacagaaacttcttgttgtcaggacaggggtttggaagacagatagaaaaacaagtaacgaggaggaaaaaaaatgatcgtttcagcgattgggcaaggattcctttgggggattcttgggttaggtatttttatgacgtatcgaattttaaattttccagatatgactactgagggctcttttcctcttggcggcgcggtctgtgtgactgctatcacgcaaggtgtctcaccgatagtagctactcttttaggggttggtgcggggatgtgtgccggattagtaactggtctcttatatacgaaaggcaagatcccagtaattctagctggaatccttgtgatgtcgggactaaattcagtgatgctgtttgtgatgcgctcgccaaatctttctctattgaatcaaccaaaaatccaagatttcttcacgaagctaaatttgcctaattactttgatactgtgttgatcggattagtgatggtattagtgatcggggctgtcttgctattctttttccataccaatcttgggcaagcctatattgctacaggagacaacgagcatatggctaaatcactagggatcaatacagacactatgaagatcattggcttagttgtttccaatggagtgattgcattatctggggcattgatcgcccaaaatgatggttacgcagatgttagtaaaggaatcggcgtcattgtaatagggttagcatcgattatcatcggtgaagtattatttggcgaactaacattattggagcggctcgtagcgattgttgtgggcagtatcatttatcagctgttgatcctatttgtgatcagagctggctttgatactacttacttaaaaatcttttcggcgatcgtcttgacgctttgtctattgatcccgcaattcaaaaatgcactgcacttgcggacgggtttcgaaaaggaggaagaatgatgttaacgatcaataaagcaaccaaaatcattggcaatggtcctcatgaaaagaagacgctcttacagaaagtagatttaaaactgcaatcaggggaatttgtgactgtagtcggcggcaatggtgctggaaaaagtacattgtttaattgtatatccggttcactgccacttactagtggtcagatcttgatcgatgaccaagatgtcacgcagttgtcagaagaaaaaagagctgcttacttgtcaagagtctttcaagaccctaaaatgggcactgcgccgcgaatgaccgtcgctgaaaatctattgttggcgcaacgtcgtggacagaaaaggaatttgcatttgcgccaattacaagtacaaaaagatgtttattaccaattatgtcaagaagtgggcaacgggctcgaacaacatttggatacaccaacaggaaatttatctggtgggcaacgccaagcattgagtcttttgatggcaacgatccagaccccaaaattgctgctcttagacgagcatactgcggcattggatccgaaaacgtctaaacagttgatgcaaatcactgcagatcgagtggaacaacaacagttgacttgcttgatgatcactcatcgcatggaagatgctctaaaatatggcaaccgattgatcttgcttcgtaaagggcagatcgtgaaagatttatccgcagcagaaaaagcgcagcttcgtttgcaagatctattactattctttgaagacgacctttagaaaaccgaatctaccagtgaaaatcgcagaaaaaaataaatgaaaaccagtgaaatgaaaaaaataagaaaaaatcattgacaactttcaaagttcaacctatacttaggacaatcttacatcagtttggagcgaacaatcatgaaacaattgcaagagaacccctcacaactgaataaatattactttagctattttagataggtttgtattcatgaaagacatgggtacaaacactcgtttgtatctatgatggctaaggcatttcgtaatgactttaaagccacgtagatcgtaaaatctatagtggctattttttatattcacatatcagctgatatgtaatgtttgaaggtgttcactgtagattctatcaatttacagtggacatctttttttgttgaaaggaatgaataggatgaaccaattaatcactggacacacccgtttagcagcgttgtttgcgaaacctgccaaacacagtatctcgccagccatgcataatctttcttttgaagatcaaaaagtggatgctgtctatctagcttttgatgttgatccagaaagtttagcagcaagtatccaaagtattcgtcagcttgatttgttaggagtcaatttatcgatgccgcacaaaatggcagctgttcctttagtcgatgaattatctcctgccgcagaactgattggtgctatcaatacaatcgtcaaccacaaaggtcatttgatcggtcacaatacggatgggattggatttatgcgagcgctaggagacatcgaggtctcgattattggcggtaccatgacagttatcggcgctggtggagctgctacagcaattattagtcaagctgccttagatggggtagaaaccattcatgtttttaatcgaaacgatgaattttatccagtgattgaaagcaagctgcaacaaatcgcggcggctactacctgcaacatcacacttggtgatctagatgatcagcaagcattgggtctggcgatcaaagagagccaattgctagtaaatgcgactggtgttggaatgaagccgcaggaagatgccagcccattaaaagaccgcggaatgttacgagaatcgttggcagtttatgacgtgatctataatccgcgagaaacacggctgttgcgtgaagcaaaagccgcgagagcaaaaacagccaatgggttaagtatgttgctttaccaaggcgcggcggcttttgagctatggactgataaaaaaatgccgattgagaaagtcaaaacactgattgaaaaaatgtaaaaaaactaataactatgaaggtaggaagaaaaaatgatcgtaattatgaaaccaaatgccacggcagaacaagtagaagttgttgtgaaacgaatcaaaaaagaaggattagatgtacaggtcaatcaagggaaggaacaaatcgtcattggacttaaaggagatacgcgtctgatccaagatgtcgcttttcgcagctacgatggtgtagaagacgcaattcgtatttccaatacgtacaaattgacttcgcgggaatttcatccgcaggacacggtagttgatgttgatggtgtcaaaatcggagatggacatttcgtaacaatggctggcccatgttcgatcgaaggattagaacaaatccgtgaatgtgcacggatcgccaaagctggcggtgctcaaatcttacgaggaggtgctttcaaacctcggacctctccttacgctttccaaggtctggaagaagaagggctgaaatacatccgtcaagctgctgatgaaacagggatgaaagtcatcactgaagtaatggacgaaggacatatcgatatggttgcggaatacagcgatattttgcaaatcggtgctcgtaacatgcagaatttcaaactattagcggctgtcggtaaaacaggaaaacctattggattgaagcggggaatttcaggaacaattgatgaatggttgaatgctgcagaatacattgctgttcaagataaaagtgaagtgatcttcattgagcggggaattcgaacatacgaaacagcaacgcggaatacattcgaccttagtgctgtaccgatcatcaaaaagttgagtcatttcccaattatcgttgatcctagtcatgggacaggtatctgggatctagttccgccaatggctagagctggggttgctgcgggcgcagacggcatgatcgttgagatccatccagatccggcaaatgcttggtctgatggtcctcaatcattgaacgaaaaaacctacatgaatatgatgaatgaagtccatatcatggaaaaagcgatgaaagaaatcaaagcactgcaaaaataatcgtcgtttttcagctgagagtgacagctatttcagaagaaatcaagtcattgtgaagtctaaaaaaaggagtgtaccatttgatgttacacataaatttagcagaacattcgtatgatattgtcattcaacgaggtgcctttcaagaagtagggaaatgggtcaaaggactttggcaacctcaaaggattgcagtgattacggatagtaacgtttccccaatctatggacaagtcattattgatgcgcttactcatgaaggatttgcagcaaaattacttgttgttccagcgggcgaaaagagcaagtctcttgagcaagcgacgattctttatgatcgtttagcagaacttgggttgacccgaagcgatggaataattgcgctgggcggcggagtaatcggtgatttagcaggtttcgtggcttcgacctatatgcgaggggtccattttcttcagattcccacgactttattggcgcaagtagattctagtattggcggcaaaacagctgtcaatactggaaatgctaaaaatttggttggaacctttgcccaacccgctggtgttttgatcgatccagaacttttacgatcattaccactttatcgcgtacaagaaggaattgcggagatcattaagtcggcagcaatcgctgatgaccagctatggcaaaaactagccgaattgcaagatgaggcggcattattggaccatgcagaacaagtgatcaccgcggctttaacggtcaaacgaaaagttgtcgaggaagaccctttcgatcatgatagtcgcttgatgttgaatttcggccataccatcggacatgggctagaaaaaacagcagcgtttgaaatcagccatggtgcaggagtagcaatcggcatggtgatggtcacccaacacgcggagtccatcggattatctccaaaaggaactacggcccaattaatagaaatgatcagcaagtttcatttgcctactcagtcagaatcgcttgacaaagatcagttgtatcaagcgatcactcatgataaaaagacccgaggaaaccaattgaagattattttgttagaaaaaatcggtcaagcgaagatcgttacgatccctacagaagaaattaaaaattatttataaaaaagagaggaagcgacggatgatgcgttatattacagcaggtgaatcccacggacctgaattgaccgcaattattgaaggtctaccagcgggattacccttaacagcagcagatatcaatcacgaactagcgagaagacaaacgggttatggccgcggcggtcgcatgctgattgaaaaagatcaagtccgtattacttccggcatccgacatggaaaaacattagggtcgcctgtgacattggtggtggaaaataaagactggaaaaattggacgaaagtgatggcaatcgaggaagttcctgaaaaagatcggaaattacgacgagtggctcggcctagaccaggacatgcagacttggtcggaggcatgaaataccgtcatcaggatttgcgaaacgtcttagagcgttcctctgcgcgggaaacaacgatgcgagtggccattggtgcaattgccaaaaaaatcttaaaggaattagagattgaagtggctggccatgtgacaatgcttggcggcataaaagcagctattcctgatggtttgactgttcaagaaattgccgagcgctccgaagcatctgaagttcgggtgttggatccttctgtcgaagaagaaatcaagcaattgatcgaccaaaccaagagaaatggggatacgattggtggcgtcgtagaagttctaatcgggggtgtccccgctggtctaggcagttatgtgcagtgggataaaaaattggatgccaaaattgcgcaggccgtggttagtatcaatgcatttaaaggtgttgaatttggtgtcggatttgaagcaggagtcttacccggttcgcaagtgatggatgaaatcctctgggatcagcaaaaaggatacacgcgtcgcagcaataatttgggcggatttgaaggaggaatgacaaatggagaaccgattgttgttcgtggagtgatgaagcccattccaacgttatacaaaccgttgcaaagcgttgatatcgatagcaaagagccctacaaagcaagtgttgaacgttcagatagtacggcagttcctgcagccagtgtggtttgtgaaaatgtcgttgctacagtagtagccaatgaaatactcgaaaaatttccgagtgactcctttgaagaattacaaacagctgtccaagaataccgtgactacttgcttcattactaaaattcattactaaaagtagtagagtttatcccactactaaaaaatatcttgagaaaaaggaaacgagggacattccaatgtcacaaaaaatcatgatcgctggtctaggattgatcggtgcttcgttggcaaaatgcatcaaaaaagctgttgctgacagctatctgattggctgggatcattgtgaatcgaccaatgaaattgccatacagtcacagattgttgacttcgtgccagcttcatttactgaaggagcgatccaatcagatatcatcattttggcacttccagtggagatcacgaaagcttatttggctgaattgggaagagtaactttaaagtcaaatgtcttagtaacggatactggtagtacaaaagcagagattgttcaatttgcgcagcaattctcctttgattttattggcggtcatcctatggctggctctcataaatcgggtattttagcagcagatgagaatttattcgaaaatgcctactacattttcaccccgactactagcaaccgcatgaatgaactgcagcgattgtttcaagggaccagagcaaaatacgtcgaattggcaccaaacgagcatgatcaaatcactggaatgctaagtcatttacctcatattattgcttccgggttagtcaatcaggcgaatacgtttaatcaatcacagcctagggctcagcaactagccgcaggagggtttcgggacatcactcgcattgcttcttccgatccccgcatgtggacggatattttattaagtaatcgacaggagcttttgcagctaatcgcaacctggcaaaaacaaatggagcaagtatcacagtggttgctgaccaaagatgaaaaagcaatattccgtttttttgaagatgctaaagaaacaagagaccatttacctatccaccaaactggagcaattccagcgttctatgatctattgatcgatgttccggatcatccgggtgtggtagcagaggtcacccagctgttaagcacgggcaatctctcattgatcaatttaaaaattttagagacgcgtgaagatatacttggtgtcttgcagatttctttcaaaagtcaaaaagagctgcagcaagcccagcagctgatcactgaaaatacgacctatcaatgtcggataaaataggagaacaatgatgaaactacttaaagctaaccacctaagaggcacactgacagtcccttcagataaatctatttctcaccgcagcatcatgtttggtgcattagcagaagggacgacgacggttcgtaattttttaagaggggaagattgtcttagtacccttcacgcttttcaagaattgggagtccccattcaagatgacggcgagacgatcacgatcactggtcaagggtttggcggtttgaaagctgctgaccgttcgattgatgtaggaaattcaggcacaacgattcgtttaatgatgggtattttagccgggcaacctttcacgactactttactgggggatgattcgttgaatcagcgaccaatgaatcgagtgatgttgccattgaatcaaatgggtgcgagacttaacggcagcaatgaaagtgagtttccaccgattactattcaaggtacacgcgatttaagcccaatcgattattcaatgcctgttgctagtgcacaggtcaaatcagcgttactttttgccgcattgcaagcacagggtacctcccgaatcgtcgagaaagaaccgagccgcaaccatacggaagaaatgattcgtcaatttggcggcgagatcacggttaaaggaaaggagattcaaattacaggtcctcaatcctttgttggacaagaagtgattgtaccaggtgatatttcttcagctgcttttttcttaaccgcaggagctgttttacccaatagtgaaatcacgctagaaaatgttgggattaatccgacgcgaacaggaattttagatgtgctggaacaaatgggtgctcagatttcactgacagcgatcgatcagaacaatcaatcagctacgattactattcgttcttctgcattaaaaggaatcgagatccaaggcgcgatcattcctcgactcattgatgaattaccaatcatcgctttgttagctacacaagctgtcggccaaacggtgattcgtgatgctgaagaattgaaagtcaaagagacgaaccgaatcgatgcgaccgcagaagaattaacgaaactgggagcagatatcacgccaacggaagatggattgattattaatggtccgacgccccttcatggtggtaacgtgtccagtcgcggcgatcatcgaattggtatgatgctgcaagtagctgctttattgacgcaagaagatgtggaattagaacaggcggaagcagtagcggtctcctacccccacttctttgaggatctccgccaattaactggaggtgatgttgaatgaaaggaatcgttttgatcggttttatgggtgctggtaaaacaactattggccgcttattagcagaacgattacagttggcacatgttgattttgacgatctgatcgttgaatcgatcggcatgacgatccaagactattttgatcgttacggggaagccgcttttcgagaaaaagaaacggagattttgactcattcattaacacttgatcaagtgatctctactggtggcggcatcatcctaaaagaagaaaatcggcaactattgcagcaatttccgaaagtcgtctatttaaaaacggagccagaagaattgctcgatcggttgaaaaaggatacggtcaatattcgtccgcttgtcgtttcgaaatcgccggcagaaatcattgatatttatcgtccaagaatgccactatacgaagaaagtgcgacagtagtgatcgataccacccgcaaatctccagcagagatcgtgactgaaatcattcaaaaagcaggtgaataaatgaagattggttatctaggcccaaaaaactccttcacttatcgagccgcctgtgaatcttttttaaatgaagaaatggttccttttggatcgatcccattatgtattcaagcattagtagcaggggacatccaacgagcggtagtccccaatgaaaattcattagagggttcggttcatgcaacaatcgatacacttttccgacaaaaggaactgatcattgaacaagaagtgattttgcctatcaaccatcagctactgaccattcagtcaggacagccgatttccaaaatcatttctcatccacaggctttggcccaatgtgcggagtttttgcaacataacttcccagatgttcctattgaagcggtggcatcgacgactgctgctgccgtctttgtcgcagagcatccagcggagccggtagcagccattgcttccaaagaagcagcccatgcttatggtctattcattcaggaaaaaaatatccaggatacgactagcaaccaaactcgtttttggatcttgcaaaaagacacaaacgaatcgagcgttttccatgataaggcaacgaaagccacgatctatgtgaccttgcctaccaatcgaccaggtagtctgcatcagattttggccgcttttggctggcgcggcattgacttgagcaaaatcgaatcccgaccattaaaaacgagtctaggggaatatttttttgtgatagatttagtgctaaatcagccttgggccttggttgagaatgccttagaagaaatcaggatgttaaattgtaatgtccatcttctaggttcgtatgctgtgaagaaaataggtgaaggaaatgaaagagaggaaaatcagtccttgcgaggatgctgatttattagctaaactttatcaaagtgttcaagaggtccatcatcaattgatacctaacgttttcaaatcctttgactacgaggcattccgcgacttgttacaggatttgcttgccgcagaaacgcatcatttttttgtagcctggcaaaaacaaccttgcggatttattcatctaaaagagattgagttatcggatacaccgctgatggtctctcaacgtcgacttgagatcgaagcgttatcggttgaaaatgcgtaccagaagcaaggggtcggtgaagccttattaacccatgccgcagattttgctcgagaaaagcagtttgcaaccctcactttgaatttctgggccaaaaaccaagtggctgatttttaccaacgaaatggttttcaagttgaacgttacagagcaagcaagattttatgagccgcttttcatctttctatcaaaaagttgctaggaaaatcttaaaatttaaaaaaatagctttctttctttttttcgtaaggtattcttataagaaagaaaagctttttttatttggaggaaactgtcctatgagtcgaatggaccgcaacaaaaaattgcatgaacaattagcgaaagaagagcaacgagctgctcataaagaaacgatctttgctcgtcgagaaacaaaatctgtgagaagacctcaaaaggaagaagagtattcagcagaaaacgattttgcacaacaaagggagaacgaccaaacaagtcagaagcggtcttctggcaatcattcgtcaaaaaaaacaacccttcagcggccgaatctgttaactggcaaaaaaaacaagtcaaaatcctttggtaaacaaaaggatttcggcaacaatggtcagtcagttaacaagaagccagcgaaacaagagcagaaagtaaaatcaaaagaagctaaacgtaagaaacggccaattttgcgtttcatcctgtatgtgctagtgtttgtacttgcttactcgatcgtggcttttgtggcagggcagcaggtggccaaaagcgatgcacaagtctcagagacggaaacgtttgatggtgtagcatctgcgaacggagcaaaaaatattttgcttttaggaagcgacagccgtaaaggcgaaactggtcgtgcagacacgatcatggtgctgcaattggatggcccttcaaagaaaccaaagctgctttctttcatgcgggatacgctagtcacgattccgggatatggagaaaacaagatcaatgcagcttatgcatttggcggggcagagttagttcggcaaacgttagctgaaaatttcggaatccaaacgaattattatgtcaaagtagactttcaatctttcgaaaaagtgattgacaccctttttcctagtggtgtaccgatcaacgctgagaaagatatgagtaaaaaccttgaagtccctatcaagaaagggcaacagaatatgaacggtttagaattattgcaatatgcgcggttccgtatggatgaagaaggcgactttgggcgtgtgcgtcgacaacaacaagtgatggatgctgtgtttaatgccatgaagaatcctttatccatcgttaaattgccatacgcagcagggaaagtcctagggtatgcttctactaatctgccagttagcttcttgctgagaaacacattttcgattgccaaaggcgcagggggcattgatcgcttaactgttcctgtcgatgattcatggcagtatggctcaacctatgaagcaggaagtgtgctggtcatcaactttgataccaataaacaagccatcgaaagtttcttaaatcagtaagtttaactgaaaactttttgaaaagagttttgaaagcttactggtttatgctatattattaatgacgtttgaaatatgttgaaacgaggaaaagaaatgaaattagccgttgttactgacagtacagcttacttgcctgaacgcatccaggatcacgctgacttgttcgttatcccaatacctgttattttagatggaaaaagctataacgaagggatcgacattcagccagatgaatattactctttgctgaaaaacagtaaagaatttcctaaaacttctcaacctgtccttggtgaagtgattgcattatacgaaacccttgcccagaaaggttatgatacgatcttaagtattcacctttctagcgggatttctggctttatcaatacgttatatggtatcaaagatgatatcaaaggcgcgcgggttattccctatgattctaaaatcaccagcatgccaatgggacatatggtagaagctgcgttggatctgaaccaacaaggcaaaaccattgaagagatcgtgacccacatcgatcgcatccgcgataatacgtatgcttatttgatcgtagatgacttaaacaatctcgtgcgaggcggacgtttaacaaatggtgctgcattgatcggcggattattgaagatcaaaccgatcttgacttttgacgaaggaaaaatcgtgctttatgagaagattcgttccagtaaaaaagcttttaatcgcgcagaagacattattggtcaaagagaatcagaaatcgcttacccagtgaaattctatgtgatccatgccaataacttgtctgtggctttagaggaaaaagcaaagctgcaaaagaaataccctgatgccgaaatcgaagtgggtcattttggtcctgtgattggttctcatttgggtgaaaaagcgattgggattgccatcgcagcgcaataataaaagtgagttatttattcctatgcaattatttgatttttataaaaatacctatgttacttagaagcttgtcaagggattccttttgctagtttctggtcacatgggtatttttttgctttaaaagcatcttgcttgtttatctgattcacactgactatacttaatccaattactactttagtaaattactaaacaggaggatggaaaatgaaaataccagaaaacttaaaacacaaacccgtcatcaaagttgaagactatgatacagtagatggacgctatgcgcttcatacggatgcgaaaggcttatcgttgggtctggcacaatggaatgatcgaggaaaagtagatatctcagggaaagtatggcggcacacgggggaaaagtggtctcgtcaatcagaagaactcccattatcacggattcttgacttagcgatccttgtcgcgcaatctagcctctattttcaagatgcctatcgtcatgaaaagttttatgatccagaaaacccactcatcgatattattggactgcaaggaaatcggatgacagtagaagttgatacagacaatcctaaaattgatgaggatattctattgttctatgatgccttgcaaaaagatggtgaattgatcggtgaacgttttcgaattttaagtcggttgttaaacgaattgggctattaagaaaggaggaatctacatggggatcaatcgtaccccttttactttgacagaaggtcgacagttcagcaagttagaacagcaaatgatttggaaaaaaccagcgagtcatcagacaagtcaagaagaactgcggatcgctcaagaaatcaagctaaactggcaagatccagagatgaagattttcaatgttttattggaaggagatgctggctctggaaaaacgcaattagccaaagctctctcctatgatcttcaattgccttataccaaaatcacctgttttgctgatatggataaatcagatgtttttggtgcattgttgccgatcgtagcaacagatcaagaagaagacagtgaattgttagaagcgatctatttgagtaatagcttagatcaggtcattcaagtgattgcggatcactattcgctcaccagtgagggtgcccgagaaaaattagcagacttgattcgacgacttgaagaaatagatacgaccgatgtcgttcattataaattttatccttcggaaatcgttcgtgcgatggaaaaagggtatctattagaaatccaagaaccaacagtcatccgggatgcctcggtactcgtcgctctcaactctgcattggagcaaaatgggatgctgaatctgccaactggcgttgtcaggcgccatccggattgtgtcgtcattatcacaacaaatcggaactatcagggcaatcgtccattgaatgaatctcttagagatcggatgcaacatgcggaaaaaatggaccttcctgaactatctgtgatggtcgcacggggacttgctaaaaccggctttcaagatcaagcgatcgctagcaaaatggcagagattattcgacttctcgatacttctgcacgagcaaatgccatcaagggtgtggctggtatgcgatcttatttttattggctgaatacggttaaaaatgggcaatcacctttaaatacgttagcggtcaaagtcttatacaagttaacgacagatccagacgaattgcgtctgctgcaagaagccctcgatcaatcagaattgctcttagagctaagacgtttgtatcaaggacagaaaatgagtcatcgacaaccaatacatggacgcatcgtatctgctgaagaggcggatgcgcgaaatattgaagaagcatccttgcagatggggacagcagctagtactgaaaaaacagcagagacactggagacacctgaggtgctagatacacaggaaacaaaccaagataatcaggaagcggtgcctcaagacactatagatggagactctttagagagccaacattcgtctgatgagggacacacaaaggaaggaagtgaacaatctgctcaagaaccttccagtcagcatctttcgatcgaagaattcaggcaattggataaagaagtaagaaaacaagcaaatcaagaagcgcggcaagcgctaaaacaatctatccatgcgaaagaaggattgattgtgcatcggccaaaactccaagaaaatgctcctcagaaagcccaacaacttctagcaccgttgttgccggtggttgaaacaataacaaaacagttgcttgaattattagaaaatgaagcagcttcttcttatggcaaaggaaaatatagcgggacacgctttgatgcaagtcgtgttgcttatggcgactttcgaacatttgataagaaaaatcctcctcatgaacagccttcattagcgatcgctttacgaatcgatgaatcagggtccatggtacgggagggacggatcaccgctgcacaacaagctgcactcgcagtgagtgtgtttgcacagcgcctagatctcccgctgatgatttatggcgacacagccgatttgtctgtacgagagaagacttctctctattcttataaggaatttgctgaaccttttgattatgtgccggcaaagctgatgtctcttcaaccccgacaaaacaatcgtgatggggcagtgctgcgggtactagctgaaaaactttcccaacaatctgctacgacaaaattactattgacgattagtgatggtcagccaaaggcaatgccagattatacgggcaataaggcgaaagcggatattcaagcagtcatcaaagagtatgaacgccaggaaatcatctttttgtccgctgccatcggacaagacaaagacgtcatcaaagaaatctatggcgcggaaagatatatcgatatcagcaatcttaaagaatttcccaaacaattattaacactgatcagccgttatttctaaattacgattcattcggctgctttttaaataacatccgtcttgcatagaagtgggaggcggatgttatttgtttcttataaaaagaatatgtaagctaaattaaacgaacgttttcaatttctgcttcgtatgctaaactgatcacaaaggaggaacaacaatgactttgaattggcgttatatctatcctttctctactgcaggagcttatttcattcgaagaagaacatttgaagaagaacattgcggatgagttatggactatttacatttgtgagttcgttcttatttttttgtgaaaagtggacattcttttttttcgttggtatgctcttgaacggcgtttaaaacagacttcacaagacagttcttttcaaagttggctctttttactccttattttcttaggggtggtcggtattctatggatcggcatggcagttatctttttcctatatagtcgttcatgtgacaaacaattccttttttccgaaggggaaaaatccgtgacgatccgatttttagtaggacaatcgcttcatttgatggctatcgaggagactcttttttccttgaacgggattggtttggctttttagattggcgattcattaggcgggattgtttttgaacgagcctttcatgattttagccagtttttatcagttgcctgctggattactgaatagcggttcttcagtgatatcttgggcatggcatttactaattggtctgctaggggtcctaggctgttggcttggctacaggagccggttgtctgaaatcgtcaatcgccatgaagtaagttgatgtgaaaggataatgttctatcgatgagaaaaaaatgaacgagtctcgtttgcacttgcttgctaagatgatgacggctaccaacgtaaatcgtttcacttagaaaaccttgcaagcgggatctctagttaataatctttgtttttaaagagaaggggtgtttttttgtttttagagatcaatgctatttccaaaagctttgacaagaaacaaatttttgatcaggtaagttatcaatttgaaaccggaaaaatctatggtattttagggcgcaatggggcagggaaaacgacgttattccaatgtatcgctcggaatatgaccgttgatagcgggagtatttatttagttgaagacggcaatcaacgaacctatgaaaatacagatgtcggatttacattcacgcaaccgcatctgccaggttttatgacggcgattgagtttttgcgcttttttatggatgtcaatcgggagcgcatcaaacagtcgctttctccagaagaatttttaatgtctgtaggaatttcttcagaagagcagcatcgtttaatgaaagattattcccatggcatgaaaaacaaagtacaaatgcttctttctttgatggtgcagccaccaatcatgttgtttgatgaaccattgacctctttcgatgttgtagctgcccatgaaatcaaacaaatgatccgatcagcaaaagaggattcgatcatactgttttccactcatattttacagcttgcacaagatttatgtgatgaagtggtcctactaaataatcatcaattgaccgggattgatccttctcacattcatgaaccagattttgagaaagaaatcgttactttgctgacggagggggagcccgatgctgcaatggattaaactttattggctttatgaagagacgattttttcaacgaaagcgaatggatttctctattttttgaccaaaattcctttgattggaaaacatcttccccatgatctttatgggcaatacggtctcaaaaaaatgctttttactgtattatttagcttgcgcttgatcttgccatttttcacaaaaattatttggctgcttttttattatgcaattgccttggttgcttttcatggttgggagaatttatttggctcttttgatcagtttgaagaacaaataatgattgctggtttttatacttggctagtggtcgttgcactagccagcaattttttttctttgttctcatttacattagatcaaaaagcgattgaattcacggattacttcatggtgtcaaaacgacagtatttgcgaatgaatcttttctttaagacgatccaatccattatttattatctaccagcatttttgttgtacagcttttttgctggcaatagttggctgaccctcgttggtatctttggtgctggctttgcttgtgtggcagctgccagtctaattcgctggggattccaaaagcaatggggcagtggctggcgcatcggttggcgactagccatatctatgctgattttagcgtcgctctacggcttattgcttcaacagattattccaactatgacattcgggttgggacttttggcgttctttctgattgccggcactggctgtttttactacctaaaacactttacacaagaaaatgattttttcctttattctgttgaaaaaagctatcagcaatttagtgtgctagaaaccatcagttcagattcaagtcaatatctcaatgaagggattgaaatgcagaaaaaactttctttggatcaggagaagccactcactcatttgcaaggatcagaatacctcaacggattgctctttcaaagatatcgtaaactgttgcgcaaaaaattgctgaaccgtgtcggtattgtgtctattctatttctaggattgattttattatcctttttgaagattgttccatatcctaatgaagaggatctgacagcactactgccagctctatttttagttatgtattttggttcattgggaaaagcaatcgtccaaatggtttttgttaactgtgacatctccatgctttactatcctttttatcgggagaaagaaacgatcctcagtgggtttaattaccgttttatcaaatcaatgttttacaacggagtctttgcgggaagtatttttgtcggcttcttattatgggacttgctaaatggattgcaagctagctggtatttcattggggtcttatttttattattgacgagtttgacagcattgttctcatttcatgaattatttatctattacttgctacaaccttttactggagatatgagagtggtcaatccggtctacaaatttgtcagtggagtattgtattggatcagctatatcaacctgcgcctgcatgtttctggatttgcttactcgatcgttgtctcaatggtcttattactctatgtttttgtcggatatgtactaatcattcgcttcgcgccgaagacctttaaaatcaaagaataggagagaatcaggactgcattataaaacctattcacaaatgcgaacatatgttttataatgagagaaagttgtgaataggagggtctagtcagatgaaaactacgttgactcttgaaatggaagaagccctttattattactgtcgcgaaaacagtgatattgtcatcgaagaggtaatcatgccggacgatcaaggaatcgttgatactctaagttgtcgcttaacaccagaaaatttgtttgaatggcgctgttatgaattaaaagtcagcctagcggattttcgttcaaaagcgaagctgtcatttattgggcattataattattttgttttgccgcatgcattatatgtaaaggtcaaggaagagattcctgctgccatcggtgtattggtttaccatgcatttgctgatcaagaaaaggggagccctggttattttagcgtcgagaaaaaaccgcagcggcaatctttactcgtcaacgaaaacgcattgttgtatcgtttgatctctgcacaagcacgagaagtggggaaggccaagcaaacagcacgaggtttgcgcgttttctcgacggaacgattgtacaaagaactaaagaaaagggaaccagaatacgatttatttggcggcggggtcaattactacgaccgttttattgaagatacgcagctacaagctattgaagcgctaaaagaagaactggttgcaacgcgagaagcttatttcgaattggaacagcgttttttgacacaagaaaaggagtagcactatgtattatccatattttcgcggcaaacaatttgacttgttggcattaaaaagtctattagaaatggaacagctgtctttagaagttcaacccgtcattgagcctatccggcaatccaagactttttgggatacagttgagctgtttcagaaaaaagcgcatcctttttttgttatcgtcaatccacaggcgggggactttctgacggaagaaggaagtcgtttattacaaacactgcctaacgctaaagcctatatcatcgatcagccaattgaaaccattgactgtcagccggacctttgggttgttcatggatctgctccagcgttggccagtgactggagtaaaaatcagacaccgatcttagttggacaagaattccgtttattgaaaaaaatccagggaccaaagattctcatgcatgatttttttactagactgcctagaaacagcttctatcaggaagtaccagaagaagtgttaccaaccgtttatcagcactacgagcagcaaggattttccggctatagtgatttttctatcgacagcaaaatctattatgcacatagttatccctctaaaacaattgttttacactggctatttattgatcagcagcagaagttgcgaatcactcattttgtttcggacgaatcattagaaactcaaaaagaaaagtttctacagctcatgtcacaagttttgcaacatgaagaaatctatccaactcaaacatcaggcttagagttattacttgaagcatacaaaaaggataagtttccaggtatgggtgttttgcggaaagctgctgtcatgaaccacttggaattaatcagccgttatcattttacatgattgttagttatgtcatcagtcatataaagaaaagtttctctcaggagctgaaatctaactgcagctacaatcatagattttggttgcagttcaatcatcactgaaatcaccaatcagtcatgcatcaaaaatcctaataagcagctgaagcacgctaaaatttgttttaggaagccaactgtacaatactggcattcaatacataaaaatcatcaatctgcgcggcaaagactcattttttactcaaaatggttcactttaagaaaaatcgctgtttttaaggaaaaatacagctcaatcagagggaggagaagtaaattcaccagattttttcagaactttaaaaattatttattttagtttacataatatatattatacaaagttatatttggaaaaagacggttcaaaatgtttttgatttttgcattttgaccctctctcgctgtctttttccccttatgaatgttgaaatcaacaacgattcgccaattttcctgtcattggtgtttatttggctgctaattgatgtattgtcttggtgtatgtcactgatcactagtttaatacatcgatttcatttgattgggtctcgtcattaagatctttcgtttgttactaagtgactcatttgtttgatttcataaaattgttgctattgctgtatatgtttcgtttataagtttatcaggtatcagattaagctgagttaatttccttaaaatcaattcttgagtttacttcaaaaaatagcgatcgatagttataaaatgcatttctgtggttgtgtctggcggctgcgacgatcatttctgtttgagttttcttaattcatctgggtgaaagccaaaccacgggttcaaaccagttgaggcattagggattaaaactggtacggactggaatccgtatagtttcacttcttcgcgaaattcttctttttcttcaatgttcttttcgatatatgggattcgatgagcgtctaaaaataattttgtctttttgcattgaatacaattagttttgcaataaagcgttatcatataatattatttctccatcctttttatttttattggtttttatgttatttttattgtaaatttaattcttgtttaattcaataatctttactcatcaacatataaataaattggtttactactgacctgatgtgagttgagggaaaaagattttgctgataaaagtcattaaaaaagtgtatctatccatccctgtcctgtttgagtttaagatcgccctcactcctatctatttttgcggcaaaatttaaagaactgttcgctttacaaatgcgaacgaatgtttgtattatagtggtgagaggtgattcttatgggcatgctccaaccctacgaagatcgaaaaaaattaaaatggcagggattctttctatcggaacatacaacagaagtcggacaggatgagcgccagcgtcactttgtgtggcctgcaaagccagccatgactagcgaagagatcaatgaagtgttgactttagctaggatcaaaagtcgagcagtagcgatccaatgtgaagaagtcaatgaagacggtctctaccctcctgacgtggtcggcatgatccaaagctacgattctttaggcatttatattgatggacgtaaagtacattacgatgagatccggcatatttcctttttcgaagagacgaaatggttcgcactggatgaatgaatcgtaggcgatgagccacgacaagcgtacaatcggaaagttttttacggaatgtgcaaatctatttttttaaaggaggtttcccctatgcaaacgattaaaggaacagtgacaaagattcgattgctgacgtttacttcttctcccctcgtccgttttacagtaggaacgacgaattgtttgatcaatcgccatagcttatcttttttagcagatgtcacggaaggcatgtctttggtggctgttggcgagtggaatgcgcgcaagcaatttattgtccgtaaatatgctgttcgggggaaaacgaaaattatgatggacatcgaacaattgtctcaacaacgaggaaaggcggttctttcatgagagcgcgggatttgctgacagcattaacgacaacgacacaacaagagtatcagggaatttacttaagccgtaaggaaaccttggtccctttcacgacgattgcacaagatgcttctgggaacttgattttattttttgaacctaatcgtcccccactatccatcaaagaactttatacgagtttaatgttgcacaaaaacttacctttgctctattgggacggtgaagaacgacaaaaggtctatgggtttcgtgaagaagatcgacagatcattctctgatcttttttctgtgagataccaaccaatcattcttcttttcattcatggtatactatagatcaagaaaacattttcaacggaggtaaaaaatgggaaatccgcgcatatacaccatgtcttttgcaagtgtctatcccctctatgtacagaaggcggagcgcaaaaatcgtacccaagatgaagtggatcagattattttttggttaactggttattcgaaagaaggtctgtcccgacaattagcagaagaagtttcaatggaacgtttcttcgcagaggcgcctgacttgaatccgaaaagaaaaatgatcaaaggagttatctgtggcgttcgtgtagaagagatcaaggaacctttaatgcaagaaattcgatacttggataaattgattgatgaattagccagaggaaaaacaattgaaaaaattttgcgaggatagtttttaagtggtcctattctataattattgcgtttcattggtccattacgtataatgagactaccttggcaggggcaaatcgtttgcttcgatccgttgggcattcctgtccgacggatttttttatttaacttcagtctaaaaaaagcgctgtggctcttttgcaggaatcccattttggtacctccctttcttaatgtgattaggaaaacgagtcaaaatgtatacagcattcaggtcacagcgcttttagtattgctatctttctctttttttacgtgcttgcaggtgttctttgtgtctcaaatagaccaattctttctccattttacggtaacggttaaatagatcttgcgagagttctccagaagctaacgcttctttgactgcacaatttggctctgattcatgacgacaatttttgaagcggcatttttctgctaaaagttcaatcatctggtaatgccgatctaatgaagaagcagcaaccgtctccaaactgatttctctcatgccaggagtatcgatgaccattgccccatttggcaagcggaacagctgtctactcgtggtagtgtgacgaccacgcccatcttcttcacgaatggctttggttgtctgccgttcgtctcctagtaattgattgagtaaagaagatttaccaacccctgaagaaccaataaaggctaccatgctttctggcgtcaaaaatggttcgaattgcgtccgctcatctttgtagatggtggtagctaaaaccggcaaagcgaatgtcagcttcagctggttgatgattgcttctgtttctgttgtgtccatctgatcgatttttgttaatacaatgactggattggctccactgttccaaacaatcgtaacgaaccgctccaagcgagcgagattaaactcttcattggcgtttgttgtaagaaagacagtcgtcacattagcagcgattccttgttcgtctggtcgatttccagctactttccgctgtaaaaaactttttcgcggcaagacggtatcaatcaaaaattgattttgatcataacaatgccccattacccgatcgcctacgatcggatagtctttcaatgctgttgcttgctggcgaaactttccggagacacgggcataacgttcttctcctgaagacaagactacatttgccagatctttcgcttgaaagataacaattccttgattttccatgaatttcctccatttatgtttggaggtgccactctataaagggaaacctccatgatcttgacgtccattataagtattcatatgacatttcccctttcgtgagtaaattcatcgattgatgtatccctagtatagcatttcttgcgattgtcagaccagcttttcttttatagctcaataatgattagccgcaagaaatgctatggagcgttgaatatcccctgtcaatggcttcaaaaccactaaaacgaaaaagctgaaactcacgcgatagacagtcctctttaaactctcttcatcctctacgattttttcaagatagctcctcgctcattaagcaataagcctccccttgtatcactgttctactattatcgttgttccttcctatcttcttctgagatccccattcttgccctatcttccctatgttcattaacttttgaccattctcctttacccattagtgaataatcttagttcttttgtaaatgattcgttatataatattctcttttctatttattcatataagaaatatttggtaaaaaaagtttttttcttttcaactgttatttaaaaaatggtatgatagcagcagaatatttattttttcctcctttattgaaactcgcaaccccatcttacgctcgcgattttacaaaggagcaaaccatatgttaggagaaaatcatggcaaagaaacttcttggtacaatcagtggtcttttgattgctgctgtacttggtatcagcttgtacacgcaaacccaaaaagacccgaaccccacttcatcacctggacactcatctactatacaggtgaaacagtcagagtcttctaaagcatcagattcgcatacaaaagaaacccagtcagcaaataatctcgctgcattgacatatcaagggacacaaaccattactatcaacaacaatgtcccctccttctcacaagataccctctctataaaaaatggtgcatgggaaaaatatggtgatctcgatcgcttaaatcgagccacttctgcggaagctatgttgaatcaatccctgatgcctactgaaaaacgcggggatatctctagtgtcgcgcctacaggctggcacaataaaaagctgaaaaaaggttatctttataatcgaactcatttgatcggctttgctctggcgggagaaaatgccaactggaaaaatctgatcacaggtacacaacagttgaataatcccgaaatgttacgctatgaaatggatatcaaatactatttagaacaagatcccagccattatgttcgttattcggtgactcctatttaccgcggtgatgaattagtggcacgaggcgttcaaatgcaagcccaatcgattggcgataatacgatccgcttcaatatttatatattcaatattcaagatggtgtgacgatccattaccaagatgggacaagtgtgctttctgaagaagcatctgatgcgactagcacttcggcaaaaaatactacatcgaatgttgctgaagatgaaaaagaatatgtagacgcgaagggaaatggtctgataaaagggtcaaaaaatggcatttatcatctgccaggtacgagaggctatgaacagacgacaaatccaaaagaatggttcaaaacgattgcggaagccaaagctgctggttatcgagcaccaaaataaaaaagcctatggcttttttattttgagagcatccctattcgacacgttaaccttatagcgcttgctcgcaccttgatttttgtaactctgtcaaatagttatttcctgcttctgttaaacgcaatgtgcgtgattttggaaatttttctctcgtgattaggcctctattttccatccgaagtagatgacggtgaatgagagaagttgatttgattccttcatgggcacaaatttctcgaatagatggtgctcgtttctgttcttgctgataagcatcaataaaaaataagatccgatctcttctaatcatattttcctccagggggtagaagacaaaagcaacggacaattgaaaaacctaagcgtttatttcctataggtaatattataaatgaaaaattcccttggaacaacagtttttgaagaagtcgctggcttttcatcgcatttgttttcttttgactttatgatgaaaagagtagaagaaaaaagtgaggcgttggtatgagttttggcgaaaatctaaaaaaattccgagaagaaaaacagctcggcgtcaatcagttggctttgaaatctggagtcagtgcagcgcaaatttcccgctttgaaaatggtaagcgtaagacaccccatgtggatactgcaaaaaaattggcaaaagcactctcagtcccattgcctttattgattggtgaatccgtttcatatgatgaatgggattatgacgaaaatcaacggcgagtggcccatcaaatcaaagatatgaccgaggaagaaatcacggatatcttagaatatatcgcttttgttaagcaaaaaaatagaaaacgctaattgaaaaaagccatctgtctctaaaaaaatagaatcagatggcttttggcctgctctctgacgagaattaccagaaatgaaattatcgtggataaactgcttggatactgtcttcaagaatcttcatttgtactagggtttcttcgtctttgactgttttaggctttccattaataatagcttcatacagtccggcataaacacggctatagtctcctacttcagaaactactttttcctcatgatagattccttcatcatcataatacgtcagacagccataatgttcaggaagatcaattccaaagtccgcatgatcaggcatataaaacatttttaaatgctcttcttggcgatctttggtttgtttgacaaacatgcctttcttaccataaacgacaaagcttggtcgttctttgattcggaaatagcttgatttgatcgatacctttaaagggccatagaagaagtccagatcgaaataatcgttcatgcgattcggacctaaaagttggcgaacttctgaatggtatgtctctggttcgccgaaataagacagcacttgatcgatggtatgacaagcatgtccataaagataactactatttaatgagaattcttgtgtattttctggaatttcggggcgataatagtcatagtgcatttctacttcaagtaaatcccctagaacgccactttcaataactttttggacagtcagaaagtcagaatcgtagcggcgattttgataacattgaatcaacagtcctttttctgcagccaaagcaaaaagttcttgagcttgtgcatatgtttcagtaaaaggtttctctagcaatacattctttccgtgaagcaatgcatccttggcagtttcaaaatgcagatggttaggagtagtcacaacgactaattgaatcgctggatcatcatagatatcgttgatatctgttgtgtaggtcgttccaggaagttttgcccaagtatcgcgaatcactcgggaatagattgtttttacgtggattttgtcggataatttagtagcaaacggcaagtgatagcgattagtgctttttccattgccaatataagcaattgttagcatagtttaaagcccccatttttcatgatagttccattatagtcaaacaaacgatcagatggaagcaagaatccttctcgctgtctatttgtatgtctccttaattaactaatgaaacaaagcgcttatcattttgaaacgaataggctatgattgattcaaaaaggagaaaacgatgagatgtcctttttgtcagatcgcagccagacagcttcctgcaacaatcatttatgaaaatcaatggacaatggcgattcttcctaaaaatcccgctgcagacggtcacctcttagttataccgaaacaacatgtaacttctattcttgcttgtgacgaagaaatatggatgcaagttaccaagacagcaaaaaaggtggcaacagattgcgtgaaatctggtaactttgaaggtatcaatttcttaagtgcccatggcgctgctgcccaacaatccgtcaatcatctgcatatccatttgattcctcgaaaagaaggcgacggcatcaatgcttggcccgattttcatgacagtaaaaagtaagaaggttattaacgagtcgtcaattgaacaatgaaagagagaatgatcaatggatattcagttagaaaaagttacctaccaaacattaccgatagcgtatcggatacaaaaagaaagttttaaacagttgtttgaacactatcaggatacagaaacctccccttatctggaaacgtatgagaatttctctaaaaagtaccaacgagagaataattatttctatttgatccaagccgacggatcagcagtaggttttgtacgaatcgttctatcagaagccccggcgctggtagctcgagtggcccccatctgtattttgcctgctaatgaaaatcatgggattggtaaaatggccattcagttagtcgaagctaaattctcgtctattaagacatggcagctaagtacgattttgcaagaaacccgcctactttcattttatcaaacactcggttatcagctatcagatcgtacgagtccgattgtgactggtatggatcgtgtatttcttaccaaacatatccactaaaactcattacttattatcttttctccccattacctatgacagagtctcttaaagagcgactgtcataggtaatcttgtttacataatattatactggtaaataaaaaacacttcttgtttccttgatacttttcgagagaaagttcaaacgagtttgacgaaaaggtctcatacaagcgttttttggacccactcattcgtttttctcaactagcttttatcagtttctttccttatttatgcaatttatttcctagttccttttcatcatctttctataatgttgctgatcttatgttataattaattatgtattttaaaactagataattactataagagaaggtggatttatggaacaacatcaaccatcctggataaaactgctttttttctttttgattcttatgggagcagatcttatgaaacaggttatcgttcatcatttcgcttggttagacgtgctgcaattaatgaatttcctaatatttattctactctcctttttcattcgccagttaccttctaccttgcgaaagattctgattggtacttatctttttattatcggtggaatcatgtctcttttatttggaaatccctttgaacttgcttcatggacactctacttcgtgggtgcgttttttggtacatttttgtgggatcatttttgtcaacgatttagacttcgttggtttattgataaaataattcgttaaaggagcgaatttcgatggattggcgcaatgatcggatcaaagcttgtcaaaatggaacaaatcccatgttaatgaaggaattatcgggtggttttgcggtttttggcgatacccaatttttaccaggctactgtgtgttgttacctaaaaaatcagtcggaagcctaaatgatttatcactggaagaaagacaagaatttctcgtctcgatgagtgttctgggtgatgccattttagccgcctgttcaccactgcgagtcaattacgatattcttggcaacacggatcaatttcttcatgcacacgtttttccacgatattcttgggagaccgaagagcgtcgttcaaaacctgtttggctatatccagcaacatattggacatgtccgcagaatacctatgatgaagagaaacatcacctcatacgtcagcgaatcacgacttctttgactgaatccgttcccggtgatcaatgagagctcttgaccaggagctttttttgttgataaaagaatttttcacaactctgatagaaaacagttgagacgtccgtataatagacaaagaggtgaaaaaatgaacgatcatcaaatgattcatttgatcaagaacaaagattataccggcttggaacaactaattgatagatacgggtcaagtattcttatgaccatccatcgaatcttacaagcccctcctgaacaaagtgaatggtcagatgtagcaaatgaagtattttatgaaatctggcaaaaaatcgaggcctatgatcctgagaaaagtagttttatcacttggatcttgctgattactcgaagtcgcggaatcgatcgcaagcgtaagttaaataaagcatttcaacaagaaagtattgaagaatatcaagagctagctattacggaatccccgttaagtgaagaagaatttctgatttggctcgaagagttatcccaagtcgatcaacaaatttttcttttatattatttttatcaagaaagtccagaagagatcgcgcaacaactggatttgcagacaacagctatttataatcacttatctcgcggcagaaaattgttgaaaaagatttggaaagaaaggatgaatcgtgatgaattttaaacagatcgttgattcagaaaatcgtcgtctcagaaatgaagtaacgcaagatgaaaaaaatcgtcttttagctaatggcaaaacatatatcttttttcaagaattgatgactgaaattcaatcactcttagataaagacgaaacagttcaaggctatctccctctctcaacttcaggcaaccttgcaatcagtaatcaagggatagctggtttgtcttatgcacgtacagaaagagcaaagcaatatgtcgtacagttcaatgatactcggagtaatcgtctatttgttttttcagaaaaacggatcctttttcttgtgatcatcgactttttagatgatcaaacctatttcagttacccctactcctcgattccggcattttctttgaagacgcgtaaactgaatcgctttgagaaaccagaagacgaggaaatcatgttttgggcttactttgattttcaatcggatagccatatttttagtgatgtattgacaaagaaagactatcaactgtttcaacatttccatgacacgattcctgcactcaaaaaaattccaatcactgaaaaaatccaccgtaaaaatcccttagattacataatcagtaattggcatttcaattatcgattgatgatattcgtcaatcttttactaattcttttagctattgggttagtcttggggatcgtctttggaatcgggatttttaaagactggtactatcgtgatttgattgggtttgttgatcagagatcattttttgtccgataattatgttataatagtcaaaaattaacgagagaaggtctacctgttttatgaaaagaaaggtactagtcccattgctgctatccttgctattaagcggctgttctgcaaacgtaccagaagaagcaaccacatcttcgagcagccaaaaacaaatgcctagcgaaaccgtagaatcatcgcaatcttctctttcagatacaaaaactgttacgagggcttctgctagcgggtctaccagtgaatcggtatcagagacggagtcaccaaagactccagaaacagcaagcgcatatccctatcaagtagatatgtcacaacaatccaatgtcctgacagtttcttttgaaggattcaacgttcctgacactgttactattgatcagagcaaagaggaagttacttttgaaagttctacacccgatgattccgtgactagccgctaccgagcaacaatcgcaacggttcccacaaaaacaattcgcgtttttagtgtaggaacgaatcaaattcgtgaagtcaaagtgaatacacaaatctcaatcggtaaaatactgggtggaacccaagatcgtaaagactaccatggtacaatgtatttgttttacaaccatgatggtgggctttccctagcaacgccgaactatgctggcaacgttcctgcagatcagatggatgtcatgcaggaagttcttccctaaatcacttcataagaacctaactttcagaaccttagcttgactacaatattgcaggaataatcaaaaatttgttgtggaggaaaatcgatgaatctcaaacgttttgtacaattgtttatttgctatttcgtatctatggtggttgctgttttactgaccaacttattcaatatttcaactatgccattttatttgttggtggcctctattattgggtatatcacattaacgatcccgttagtagtcatgacgatcaagaaaaacaaatagttccgagagtggatttattgaaaggagcatcagatgattggcaatgttcgttatctaccaagaaagttaagaaaatggtacattctctatcttatctgtctgatacttatttatggctggttgttgtttactgatcagtcagcggtacttgctgtcgctattcttctcgttctttttgcaatcgaacttgcatttatgtggcattcagaaaattcttttttaggcagtgttctggttgcttgtcttctttatggcatctggatgctacctttcgtgcttcggtgattagttttcatttattcgtatcgaaagtgaatcggagaagctagcatagagaattttcttaaaaaaatacccagagaaaagagcaagtcatgacgttgtcattgacgataggtctttgcagtaatgcaaacactgagggctctattcctttgggtattttttgttcaatttaactaatttaacttagtgagtgacaaacaattattgctctcgttcaacaagtcggtaatagacttttgctgtgataagatataccaacagataaatgactgcgaaaagagcaactgatacaacagtcacactgatcagcagattgcggtcggtcaacccgaaaagcaaaagcagcttgcgaattatcggaaacgcgaatgcaaggtggatgatcgcagctaccaatggaaaagaaaaaatcatcaatacttgttgttggatcacttgcttgacttctttatgacttaagccaactttctgtaagatctcaaaacgttctttatcttctattccttcagagacttgcttgtaatagatgattaatgtagctgccaaaataaagatcagtccaaaaatcaaccctaagaaaaagaatcctcccgtaaacgttttggtctgtacttggaagagatcttttgattcaatgcgtgcattcggatcagctgcttgaaggtcctttcgtatctctttgaccattgtttctcgatcactggtttcaggcacttggaagtcaaaaacagtagtgatcactggttgttgatagataaggaattctttttcctgataccaactagttaatttctcagaaagccaagtatcatcgactaccaccacaagttgttgaacgggattctccacttgagtaaaaggtggcagctcagttagtgatcgaagagtgaactgactatgatcgatcgtcagctctttaggcaacgcttgatgggtccaagtttctggaaagaccaacaattcatctttttctggtccttcttttcctgtgattctttggtactccgtactagtaacaaatgtgagaaagaccgctttttctaaattctcgctgttatcttcaaaagttgttgaaggagtaagtgtgtttccctcaaccgtaaaaagtaagtctttagtagcagtgacttgtttccggtttttgagcgttactttattttcaagactatcgatggcttggttcaattgttgcagattcgcctctgactcgatctgaaagtcataaggaaatcgtgtttccaccacattcttctgtccgaaataaagactagctgttgtggcaacagtcactaaaaccattgttgacaaaatacaaatacttgctagacctgctgcattttgtttcattcgataaagcatcgttgatacattgatgaaatgggtcgtctgataataataagtggatcgctttcttaaaaactgcaatgctttaatactgccagaaataaacaacagatacgtggcgatgatcacaagaatcacagcgacaaaaaagagtgctaaggcgctgatgggcgacttgattgtgacagaaatcgtataccctaccgctaaacaaatgatccctagaagggctaaaaagccttttgctcgcggctcttgttcattgcgcttactaccttgcagcagttcgatcggcttggttcgccggacttgcagcatattgaatagaaaaaggcagccataaaccatcaaaaagtaaaggatcacaagaccgatactttctacagaaagttcaaagacgaaagattctcccacctctagaattctttttaaaatcaagaaccccaatcgtgcaaacaaaagacctccaactagccctgcggccagactgatgaggcagctataaaaaagttcccaaaagaccactaacgcaatttctcgtttccctaatcctagaacattgtaaagtccaaattctttttttcgttgtttgatcaaaaagttattggtgtaaaacgaaaaaatggcggcaaaaatcattaaaatgatatttcctagtcgaaacataaaaatagcactttgactgcttggcagtttattcattcctggattatttacaatgatttgtgtcatcattatcactgcaactagaagactcatggacagtaaaaaaggagtataagctttggtgttttttcgcaaattggaaaaggcgattttttgaaagaacattccttactcctcccttgcaaagacagctgtcatggtttccgagattgcttctagaaaagcgctattcgttcgttctccgcgataaagctgatggaagacgtgaccgtctttgatgaataatactcgttgcgcgcggcttgcagcaatggaactatgagtaaccatgatgatcgtttgtccattctgattgatttgctgaaacaacgtcagcaattgatcggaagtttttgaatctagcgccccagttggttcatctgctagtaagagatccggctttgtgataatcgcgcgtgcgacagctacccgttgtttctggccgccggataattcatagggatagtgttgtaacaagtcggtaattcccagtgttcgcactaatggttgcagtcgttggtccatttgtttgaccggcactttcgataagactaatggtaataagatattgtctttgacagaaaaagtatccaataaattgaaatcttgaaaaacaaagcccaaatgatctcggcgaaaacttgcagcgtctttttctttgatggtcgtcaaatcgataccattaagcgctaattctcccgctgtcggttgatctaacgtggccatcaagttcagtagggtgctttttccagatcctgattctcccataatggcgacatattcgccttcttctactgaaaacgtgatattcttcaatgcttcgaccggctggccgttcaactgactttgatacactttttttacttgttgaatgtttaatagtggcattgttctctcccccttcttttttagcataagctgtttagaagaaaaaagcgacttacaataaaaaacgcaaacttacagtgttgaaagtttgcggtcaaataaaatttttagtgggaaaatggatcgtcaccgtagttcccttccctacttcggagtcaatcgttagctgacagccgattttttctgctgcttgctggctcaaatataatcctaatccgctagcacgctgctgaaagcgtccattttgtcctgtataacctttttcaaaaacccgcggcaaatcttcttgacgaataccgatccctgtgtcttgaatcaaaagacaattgttttcggtaaaaatccggattccgcctttttctgtatacttcaggctattaaaaagcaactgctcaaagataaaagtcagccatttacgatccgaagtaacggtcaagtcgatagccaaatccagttgcaagtctttttttgaaaaaaacaaggcatattttttgattgcttggtgaatgagaggtgctaacacaatcggttcaaaaacaaagtcatcatttttcaagttttgtcgtaaataattcagcatcatttgcaaataatcattcactttaaatagttctgctttgacttcagtgggcgataggccatcactttgcactagcaaatccatcgctgctaatggtgttttgatctgatgcagccataatccgaagtcttcgtagatttcttcattcttcaaggctgcttgatactcggaggcggttttttctttagcttgtcgtttgattagctgctggtattcttcttcgatactgtttcgcgcaatcggcaagaaagccaaagctgcttcagtgatcattttcttggctaataagttttgtaactgacgtcttttttgtagataacgcatatattgccagacagagaaaatacctaaaatcactcctgtgaaaatcacataatcgatgaagggctctaaaggaagctcatggagaaagaacaagcctaaaagaccgctactaaacaaaattaaaaacaaatagaacttgccgtaaagcaaaaaatactcttttaagttaatcataggcttgttccttttcaatcaaatagcctttgtttttcactgtttgaatcaaatcagacaatccagtttgacttaatttctttcgcaagcgggtcatgttaacggctaatgtattattatcaataaactcttcgctattccaaagcatttcaataatcgtttctttgggaacgattttcccttgctgttgcaagagtaaggaaaggattcgagattcgtttggcgacagcggcaaagattccgttttacttttcagcaaattttctattggatgaaaagtgacatctcctaatgaaaacgtctggacttgttgatgggtatattggtagctgcggcgcaacagcgcttggatcttagccaaaacaaacgccaaatcaaaaggttttgttaggtaatcatcggctcccatgttcattgccatgatttgattcatttgttgatccattgaagaaagaaaaatgattggcacttcagaaatgttacgaatttcttggcaccaatggtacccgttgtaataaggcaaagaaatgtccaaaagaatcaagtcgggacttaccgcacgaaattcctgcaaaatttcagcaaattttttggcgggataacactcatatccccattgtcttaaataatcagccagtactgaaacgatcgtagcatcatcttctacaaggtatattttttgcatgattctctcctatcactaaattggtgaagctatcacagacagtgtaccagaaaataaaaagaaacgtctagttgagataaatcattctagacgtttctttttatttacactttttcattcgactcactttttttaagtgcattgcggattgatgggacttgcttgattttcattagatctaataagaaagtaaatagtgggatccccacgatcagaccccagataccaaagagatgctcacccagatataaaacaatgaacgtatagaacatgggaatctctgttttatgggacatcagccgcggattgagaacataggactcgagagcatgaacaaaaataatgattaataaaacatagacaacatcattgagtccgccaatcgtataggcaataaaggttaatggaatacaagaaatgatgactcctgctactggaatcaagcttaagaagaaaatcatcatggccaaacttaacagctgaggaaagcccatgacagctaaagcaagcactgtgatcactgtattaacgatagcaatcaatagctgggtttcgatcacacttccgaatgcgcgggtaaatttccttgcgagatagtaaacatcctcaaaaaaccaggaagcactcccttgcaaaaagagctgagaaaatgccactgtttttttgttgtcaatcataaagaaaaaactcaataagaaagagatcaatacagtcaaagccaattcaccgaagttgtaaagataattgatgacgacgacgactccattttggattttttggacataatcgcttgtttgcaccaaatgtagcaaatactctaataactcattgttagagtctgctttttgataaaaatcggtcactgacttaaccagttgcgcggattggttcaaaagaatcggtgcatacttggtaatgactaagtaaaccaaagcgacaacgatcaagtacaacacgattgaaagaagtttgattgacacattcactttcttgcgtattagctggaccagtttgtaaatcaaataagtaaaaataaaggttaataaaataatagtcatcatactgcgaagcagaaataagatcccgcaaagaaagatcagcactgtccaacgtcttaatggaacattggcaacaaaccgatggtagtaattcatgaacacgctccttttttcaagtcgtcaatcaacgactgttacttcattccccaattaatctaaccactttttgaagcaattatcaactcaaatcaattaagaagactattgtgggtagagtcatatgctaaagcaaaagcagcctgctgtcagtggcaactggaccaagtatcgtgaatgaaggactgatgattattttcaaaagataaatgcctattttttcgaaaagtttatggttgttttaaggttactatgacacaatagaccttgacagaataatttacagtctgtcttagcggaaactaaggcagacgccttttttatcaaaaactgccctttgttcggtttgtatcgaacaaagggcagtttaaacgattctatatttattcttatcagttgttactcctagacgaattgtctgctttccttaaaaggacgctcactatgcgactagctcactatgactaaagagacaattcttgacgaacttctcgaagaatggcatcaacggtcaacccattttcttgtagcaactcatttgcttgataacggtcatgaaaggctttatctaaaccaaaattgacaattttgatcggagattttcctaaataactagcgacagcttgtccatagcctccttcaagaaggccatcttcaagagtgagcaacaattgatgtgtagcaattaagccagacaatgtgtcagtatctaatccagaaataaatctaggattaatgaccgtaggtgtgatcccaagctcggtttctatcatggcagctgctttttttgccaggccaagagcatttcctacaccaagtaaggcaactttgctgcccgcttgaatgagttgatttttgtttagttgactgtaatctgtttgatcgacacgacctgattctaacggaccgacaggaacgcgaattgccactgggtgttgggattggtcaatagaccaatccagcatcgctaaatattcttccttattggtcggtgcaagataaacaagattcggaatatgactcaaaaatggaatatcaaagatccctaaatgactttcatcattcatgccataagctgaagcgccataaactaaaatagttcccgccacattgttcaaagacaaatcatgagagatttggtcaaaacttcgttgcataaaggttgaaaaaactgcccaaacgggttttgctccattttttgccagaccggcagtcatggttgcagcatgttcctctgcgatcccaacgtcaacaaattgactgccggcgatttttcgttgttcaggggtaaaaaggatcatcggcgtgccagcatttactgcaacgactgttggatcctgtgccattttttctaaaagataatcggtcgttaccgttgaataagtttctccaccagaatttgcaagataattccctgtttcaagactaaatggtccaccagcatggaatttctcgcgattttcttcggcaaatttgaagccttttcctttaacggtctgaatatgaaggacaacaggatgattgctgtctttcacttgtttgaatagatgcatcaaggctgtcagatcattgccatcagcaagataatagtagtcagaccctaatgacttaaagaaattgttttccgcttgaccattcgtatctcgcaatgctcgtaagttattgtagagacctccgtggttttccgcaatcgactggtcgttatcatttacaatcacgatagtgtttgttccagtctccgcgatattgttcaatccttcataagccagaccaccagataatgagccgtcaccaatgaccgcaattacgttcccttcttcattttttaagtctcgtgctttggcaaccccatttgctaaagacaatgacgtggatgtatgccccactgtaaacaagtcatggtcactttcttttggattggtataaccagagacatcgctataatgcgctggatcccagaaggcttgacctcgcccagtcagcattttatgaatataggtttggtgagaaacatcaaaaatcattttatctcttggagaatcaaagacagcgtgtaaagcaaccgtcatttcgacaacgcccaaattcggtccgttatgtcctccatgatggctgattttttctaataacacggttcttgcttcctcactaacttgttgtagttctgcaacggataacttctttaaatctgctggatctgtaattgattttaataacatcaaaaaactcccttctctgtttgagagtatactgcttcaccttcactttaagtcaagaaacttttgaaactttttcacgaaagtaagcaacagacaggtagaacacatgaacacaaaaaagcccacccttcaacttgtcatggtgatctgttttatcagcagaaaagttgaaggagagactctttcaaaagcattcgttatgagacacgatcgttttccagcgttaaatgatgtaagtcaaatcacttgcaggagttggataagcaaagatcagcgcttcaatttcttggtgagtgagctgtttttccagaatcaagtagcacaaattaatcaattcatctgcgatacttgaaagacaggtaatcgcaatgatttgtccctcttgattgtaaacaagtttaagcatcgcaacaggatcgttgatgcgacggtacgtaaaccaatcggcaaggttgattgtttcactatggatctgcagattttgagcgagctgtttttcactttgaccgatccgagccaatttcaacccaccaaagacgattgtaggaatcaggggatacgtgattgcagaacgagaacctttttggctcattgaagcgaccgcatattttgcttcaaaacttgaaacaggcgtcagtttaggttgttccttatccaatacatctccacaggcaaaaactcgtgggttcgatgtttgtaaatagtcattgactttgatcccgcgtttggaataatcaactcctgcattttctaagtgtaaggattcaacatttgggatgcgtccagcagcacttaccacgtaatcggtgtccagctcaaagcctgtaccttgcagcgtgtatccttcattgatttggctgatgctttcaatctctacattgaaatgaaaggaaattccttgcttttgtaattgctcaacaaaggcattcaccaattcttgatcaaatgctttcagtggtctgtcgttatgatgaataatgtgtacctctgctcctgctgcttgagcgattgtcgcaagttcaaaagcaacataccccgctcctaaaaaagtgattttcgcgggcattttttccattgcaagaaaatcggtgcttgtatgcaaatattcttgtcctttaatcgggagtagcgcaggtcgttgtcctgtagcaatcaagaactgatcagctgaaacgatttctgaaccaatccgcagcgtttgttcatcgataaatcccgcttctccttcataggtcgtgattccagtatccactaagccctgcttcgtctgtgtgggaacagtgtccgtgtaactgcgcttgaaagccatcaaagttttccagtcaatacccagctctccagtgatcccttttcctgctaagtgagcagccttcgcctttgcttcaacggcactcattaaaatcttcttggggtcgcacccgcggttggggcaagttcctccccagagatcggcttcaacgattgcgacagtcttcccttgctcgctgaaagaataagccgcagcagttccggatggtccaccacccacaacgattacatcatagttttgcatcttgctcctcctgacttagaaaatgaaagatatctgtacggctaacttcaccaatcgcttgtccttgttctgtaacaaccaaatgttcgtggttggccaagacttcatatacttgtgaaagagggactttcacatcgagggacattccctcttgtgtagttgattgttggtagtaaccagaatcaataatcgcttgaagacgttgttcttgctgtgctccttgtgtttcgtcaaaaaaggcgcgaacgaaatccgtttttggctctgtccgtattttttcaggcgtatcacattgtaccagtctgccttcattcatcacaccgattcgatctcccaattttaaggcttcattcatattatgggtaacaaagacgatcgtattgcctaatttattatgcaaatctaatacgagatcctgaagattggttcgagaaatcggatcaagggcgctaaaaggttcatccatcaagatgatgtccggttctgcagccaacgctcgcaagattccgatccgctgactttgaccacctgaaagttcagccggcatccgttttttgaacgtctctggttcaagtccaacctcagtgagtagttcatcgacacgttgattgcgacgatttttatcccaaccgagcatttctggaatgatttcaatattctccttgacggacatcgttggaaataaagcaatttgctgcaacacgtaaccaattttccaacgtaacttttggagttgatagtctttcactcgtttttgtttgaagtaaacattgccttccgtcggttcgatcagcccattgatcattttaagggaggttgtttttccgcttcctgagggacctactaagacaaagatttctccttgatgaatggagagatccaattcttttaatacgacttgtccctcaaattctttgacaacttgtttaaattcgataattggttccatttagtttccctccccaataatcttttctttttttagaaattcacgagcaacatctgccggttgttttccttccacattcacttgatagttcatgtcaatcatctggtcctctgtgatttttcctgatagttttttcaatgctttgacgacttgcggatgttctgcagcaaattcatctttcatcaatgcggctccttgataaggtggaaagagctgtcgatcatcttctaaaacgacgagattgtattgtttgatctcactatctgtcgaataagcatcgatcacatcgacatccttgctttgaatcgcttgatagcgcagtgccggttccatactttggacagaatcaaaagtcagcccgtactgtttttggatcccgcgatagccatcttcccgatcaataaactctaaagtaaaaccagcccgaagctctgactcatgagcaactaattcagaaatcttcgttatacccaactcttctgcttgttcacgacgcatggctaaagcataggtgttttcgtaggtcatcggctctaacaggcgcatattaaactggtcactaagcagttttgttgcttcttgataagttgattctggagaaccatctatttgggtattttctgggactttgactagactttctaatactgttcccgtaaactcgggataaatatcaatctggtcattttcaagggcgctaaataagaaacttgttttaccaaagtttggtttgatctcgacggttaaactaggatcttcttcttcgatcactgcttgatacatattgataaggatatctggttctgaaccgagtttaccagcaatcgttaccgttttatttgaaataggattatactgtgcgaaaagaattccgccgattccaagaaagataacacctaaagagatcagtgtggttttcatactgcggttttgtaaaaaacgaatcagtccactgaataagattgctaatagagccgaactaaccgcccctatgagtgtcaaactcggatcattacggtcgatccctaacaaaataaaggttcccaatccaccagcaccaatcaatgctgccaacgtggccgttccaatgatcaacaccaatgctgtacgtaccccagaaatgatgacaggcattgcaataggtaactcaactttgaagagttttcgcaagcgagacataccaaatgcatccgccgcttcttcaatcgacggatcgatttcggaaagcccaatatacgtgttttgaaaaatgggcagtaacgcataaactaccaatgctattagagcgggaacggtgccaataccaacaaaaggaatcaataatcccaataatgccaatgatggaattgtttgtagaatacttgtgatctgtaaaacaaattctgccattcgtttcttttggctcaacaaaattgctaatggaatagcaattaaaatggctaaaatcaacgcactcagcgaaatggccaagtgttgaaagattgcccgcagcaactcctcctttcgctcgctaaacgcttgaatgatttcgttcatatattccatcctccactattctagtctgccttaagtatagctgaatgcccaaacgcaacaaaaagatacgctcagcaggattgggagaaaagttggcctttcgcatctaaataggatccattatttcctgacattctgttacaataagtctaaaagaatgaggtgcttctatgccattactggttttgattggtgctcaggctgttggaaaaatgactgtcggtcgcgaactttaaaaaagaattgatggtaaattactatttaatcatcaaactattgatttatttgccaattatcttgggtatacgcctgcggcatttaagttgtctgattccactaggatcgaacttttcaaagcatttgtggctggtgaacagaatacagttaagacaatcatatttactgttttagtgggatttgatcagaaagaagatattgcttttttacacaaaatttgtgagatctttttaagcgctggacaaccggtttattttgttgaacttgttgcgcaattagaggagcgcatcgcacgtaaccgtcaggaagcacgtttaaaagcgaagccgtcaaaacgggatcttgctttttcgcatcaagaacttcttacttttaatgaaaaataccgtttggaaagccattcgacggaattggcatccctttttccaaaagtaaaaacgatgaaaatcgataatactgagttgtcacccgaaatggtcagccagaaaattattgctaacttccaacttgaatgaaagataagaaggacactaatcttaggaaagcagattagtgtccttctttattcttattttagtcaaacatccgatgtcgctgtgaaaaaaccatcagcaaaagaaaagacttccccaagcacttctattactgatggttattaaaattcacgttgcctttttatgataagcgacgtgtattgacactaccaaatctattttttcattccttcatgaatattatgactatcgtataaaaatgaataatcagctgattcgagtttccttctataaaatcatctttctacctgatatcctatcacttagggaaaaaatagtataatcactttttgcactggaacatgaaaaaaagaaattaaagactttaccacttttttattctcagtacttgaaaagctactccatctaactgatcaatcaatcatactaactcctgtcaccggtacaagcatttctaagttgattgaccatgatcatggtcaatcaagtctgtcaatccgcatatatctatattagtactactgattatttatctttttatagagacttatagccctttcaatgctgcgctgcttatttggcgattgaaacgttatgtgatttttttagttgaacataagcaatattcaaaataaagccgacgactgccaaagcaattgctgtatagaatgcgtttgtaaaatctccattgttgctggcagccattcctgctgctactcgtggtccaaagaaagcagctgtagaataaccaacaaagacgattccatagttgactccttggttagctggtccgtaattttccattacgatcgatgggaaaacccccatcactccgccaaagcagagtcctagcccaatgattcccactgcaaagatcatcgctgcacttgaaagtgtcaaaacgagtaaagataacgctacgacaccgtaaatgatcatcaatgtattggaacgcccaatcttatcagaaactgttccccaaatcactcgacctaagcaattgctaaaagaatatagactaacataaaaagcggctgttgtagctgttaatccgaacatttcctgcccaatcacagcagcattggaagcaatcatcaaaccagaaaatgccccaacaccgagcatcaagataatcaaataaaaagcaggtgttttcatcatctcttgccaggaataatttgctgcggttcctttaaccgcagaagtttgtgggacccatcctgctggacgataatctgcaggggcttttttgataaagaaacttgccattacaacgacgatcatataagcaataccgataaaacgaaaagcagtcaacacatctcttgattcaataattgcattcgcgatcggtgcggcgatgatggctgcaccgcccatacctgcagtgatcaatcctgaagcaagtccacgtttgtctgggaataaacgaatcgtattacttaagcaagcagaataagcaaatccttgaccaagacctgaaagcacaccataagttagatagagcatcccaggtgattccacaaatccagttaagaagaaacctagcgcaaataataaaccaccaaaagtaatcgtccattttgccaatccacggtcggtcaagaatcctcctaaaatcattgtgataggtccgacagcagcattgattgtaaatgccagcatgatttcttccattgtccaattttttagttgactaagcggtccagcgaaaacgctaaatgcataaacggcacctgtacataacagaacagcagttgaagcaatcaagactagccaacggttgagttttgtttccatgttttacccccaaaaaatagttttgtttaaataaattgaatgaatacacctcatgttacttatttcacataacgttttgaaagaaaatgtgcagtgcgattctctgcacatttcttttaacctattaaagattttctgcaactgctgtcttaccagcgatccgtccaaaggtaaagatatcagtcaatgagttaccaccaaggcgatttcctgcatggattcctcctgctacttcaccagctgcatatagacctttgatcacttgattttcttttgataacacatgggtttgtgtatcgatctttaacccccccatggtgtgatgtactgccggttttcttggagttgcataaaatggagcagtcgttactttaagatcaaacacatctttgccaaattcaggatcttttcctgcatcgacataggcgttgtatgcagtgatcgtttctttcaagatggttggatcaacattaatttgttctgctaattcttcaagggtatcggcgcggaataatgttccgttagctacttgtttgtcgattttttcttgggacgtattgtacgctgttttcttgatttcttcatcagcaatcaaatagaataggccaccattatcgattgctgcttgtgtcaatacatcacggctttcatattcattgacgaaacgtttgccttcttgattgaccatcacaaagtttgcgggaggtacttgcagaccgctgaataatgctcccgtattcggatcagataccggcatcatttgtgagaagcccattccaactagatccgcaccggcactttcccctagtttgataccatcccctgtgattgccggcgaattggaagttttgatgtcatcttcgatttcagtccaatacgtgttgtactgcttcagcatttgtgtattcgcaccgaagccaccagaagctaagataactgctttggcatggatcgttactttttgtccattgcgaccttccccaatgatccctacgacttgtccctcttcgatgatcaattctttgactggtgtgtcagtaagaatttttccaccattttcattgacgaaattgtgtagggcagaaacaaaagcgtacccttcatttttcaatggtttatggcctcggcgccattttgctccaactggcatatcgacatgtttgtaatcaaattcaacgccgatttcttctagccatttcacagactctagtgcacgatcagttaggatttttactaagtcatattgaccgtaaatcacatttccttctaagtcggtccgtttgccgcctaaataagtttggatacgatgccagatggcagagtcaaataagaattctttttctggagtcgttgcttgtaaatacgttgtgatttgttctttcaacaatcgaaaatcagccaagtattctgcatcaatggttgcttcatctacggcaatgatttcttctagcgcagcccgttcacctggaagcgcagcaaatgttttttgccaatccggatctgcggcattcattggtccacccgtgcgaacggtattcccaccgatggctgggtatttttcaactaaaatcacctctttgccttcttggaggatacttgctgcggcactcaatcctgccccaccaccaccgacaacgatgatatccgtggtgtaagtttcatcttccgtttttagcgcactggctgccttaggacgttttcttaaaacatctgggtttgcaccagccattttcactgctttcgcgacaccatcaacgacaccgttactggtaacggaagcacctgagatcgcatcgacgttcaatgtttggccttcaatgatttcttgtggaacacgcgcaaagactacatctgcgattccttccgattcaccggaagtatcgatattgattgcttcgatccgttcttcacttaatgtaaccaccattggtaaatcaccattgtgtcctggtgccgtgacagtataatccccaggctgataaactacttcttcgggaacattcaagatattagcaacttctgtaaagcgaatgaattttctgaaacagctttccaaaaagtcaacagtccgttgatctttcagctgcccattttcatcgaatgcttgatgcgcacgacctaaaagaaattcattaccaggcataaccgttgcattgacaccaggtgcatcaagaatttgacgcaagtgtagttgtgcccgtgaagaaccttggacgtcataagaagcacccacgatcatcactggtttgccatcaaacgggtgtagattgaaggacaaccattctaagacactttttagtgcggatggaatggaatgattgtgttctggtgtcgcgataatcacgccatcggcagccaaaattttctgatttaatgtttgaatgacttcactattggtttgatcctctgtttcattgaacataggaacttgatcaatttctaaaatttcgatttctgctaaatcggcaaatgcttgttgcatatatgtcaccagttggcgattagtcgatttctttgcatttgtaccgatcataccgacaaatttcatggacatttcctctctttcttatacctgttcccaagaaaatttctttgagcgctctttggcagtcgaatattcactgacgagacgattcgtgatttccacgaataatttgaattcattgaagcagtcttctaattcagcgactttttcctcatcttttaagcatccttcttcatcaaaggcttgcatcgaatgaccgagtaaaaattcggcactaggcatgattcgtgctttgacttccggtgcatcaagaatttggcgaaggtgtgcttgcgctcgggaagaacctaaagcaccaagtgaggcaccagtgatcatcactggtttgtcgatcaagggacgggtcgtataagaaagccattcaatcatgctttttagtactgctggaatggaatgatcgtattcaggtgtactgataatcacgccatcagcagcctcgattttttctgctaattctcgaactgcttcaggtgctgttctgtcttctggttcattgaatgctggcagatctttgatttcgcaaagctcgatttctgcctgatctttgaaatgggtttggataaattgcaataactggcgattggtcgaacgtgcagagttagtgccaacgattccgatcagtttcatactcatctctcctaaatgtgataaatttaacaattgattcgattataactcgcttttagatcaattgtttcaaaagttaatcgtacaaatagtcgtcttagaaagataaaaatggtcaaactcagcttaaatctctctgatttcattccgatagaaggatctgaaggacaatttatttgttccaattaagtacttctacagtttagtctgaccattcacatttgtgaaatatttatttaattatattatgataacttttttgttataatagacatatttctacggaaggagcaacttctatgtctcttaaagattcccatttgatgctgcagtacatcgacacattactaaagtacaataactataccaaagcagcgaaagacctatttatttctcagccttatcttacgcaagccatcaaaaaagtcgaacaagagttgggaacggccatcattattcgtcagtcaggtgttttgcatttgactgaagccggtaaaatctattatcaataccttgaaacattggaaaccgcttccgcgaaatttcgtcatcggttactgcgctacacatcaccagaaaccaaaacattgcgattgggtatcttgcccagtctgggctcgttcttgctcccactttttttacctgactatttggcagaacaccaggatgtgaccgtttttttgcgtgaagatttgccaaagcacaatgagaaacgtttattaagtaatcaattggatttttttgttggccaaaacccggagactatttcacctaatttgacgacttacgccacaaagagtgaaaattattttgcgatcatcccccctatttcgcctttgtatcaagcaaacaaaaaatttctctctcaagacagtgtttcaatgaaagaactgttacaaagcccgttgatattgacgacaagcggctccgcgattcgtcggcaaattgatcaattattgaaaaagtacaaagttgaaccaaccattctcgtagaaagcagcaatatttatactgcagcagcacttgctgaaaacaatctcgggttggccatcgttcctgaaagtgtcttgcaagcagcgacaatgacgcctttcaacctttatccgatacctgaagaaatgctaacgttaaattattttatcgctcatcaagcagagcgtccgttatcgatagctgatcaaaacttgattcgctattttctagaaaaagtatgatcgctaaaaccgccatcaaaagtaaaaaaaacatactcaaagaagaaagagtcagaagtaatggtatgtcaaacgagctaaacagattaagcaggcactttaagatcgtgcaattgccagggggcgcagtcgttctgctatcttgtttcaccagtttaaatacttcattttacttcatttaccagactctgaaagctgctttgtcaaggcagtttcgtctctatctttgagtatgtttcaattaggctttttgattcgtttcaggtaactcaatcagtggttgtagcgtagagggataaagcaattggccttgtcgggttacgattaatccagtgatgccatcgagttggctgagttgtttcatgatttcttcagtttttttaccaaagagacgtgtggtccaaatttcgccatccactgaacgatcggaaataatcgtgatacttgctaacgctgattctatcggataaccggttttacgattgaaaatatgatgataggtcttaccgtcgacggtgtgggaacgttcatagatccctgaggttacgatagaacgatcgcggatttttaaggctgccacgaaatttcctcttggcaaaaaaggattctgaattccgatacgccataagtgatccgcatgatttggtgtttcaccaaaggtaacaacattcccgcccagatcaatcaaagcggcactgacaccagattgcttaaaaaaatctgccagctgatctgcgaaatagcctttggccacagcacctaggtctattgacataccggcagctaaggcaacgctctgctgttggttatccaattcgattcgttgaggatcggtcacctgtagtaattccgtcactttttcggcagtcggcactttggcatctgagaaaccaatacgccactcctgaaccaggggtcccatcgcgatgttcaagaaactatcctctggcaagctgtgctcttttgctaaggcgatcaaagcaaacaagtctttggctactttggtcggctgaattccggcgttttgattgactttcatcagatctgaagcaggatcattggcactaaaccgtttttcaaacgctctgatttgttggactgctgcttccaaaattggtgtgggatcttcatgttggatccaaagctgaatgatcgttcccatcgctttgacttgtctttttccttcttgcatccgttcgtttcgcccctagtttttttgttcatcatagcagtttttcagaaaaaattgaatgcctttagcaaataaatgcaactataagaaagtcgcggacaggctttaaaacattaaatcacccggttcaatgaaatcatttcgatcaatccttgcgccgcttctgaacctttattgcccgctttggttccggcccgctcgatggcttgttcgatagtttctgtagttagaacgccaaacatgactggaatgtctgccgctaatccaacttgggccacgcctttcgcgacttcattgctaacaagctcataatgggtagtcgcaccgcggataactgcacccagtgtgatcaagccatcgtattgcttcacgttgactaatttttttgttatatagggaatttcaaaggcaccgggtacccagtaaacatcaatgtcttcttcttttactccatgccgtatcaaattgtcttgggcgccactcaaaagtttcgccgtaataaactcgttaaaacgcgcaaccacgatccctactttcattccttgtccgtcaaatgttccttcaaattgtgtcatgttgtgctctccttctttctcaaagtgataataaatgatggaatttttctttttttgtttgaagataacgattattttctgcaactggagttatttctaacggaattctttcagcaacatgaatgccatgagcttctaactcggtgattttttctggattatttgtcagcaagcgaatcgtatcgatgccaagagacttcagaataatcgccgcaaaaccataatcccgttcatctggacgaaaacctaattcaacattggcttcatacgtatccaagcctttttcctgtaattgatacgcctgcagtttctgtttcaagccgatacctcggccttcctgacgcaaatacaagatggctccggtaccttctttttcgatttgacgcatggcttcatgtagttgttccccgcaatcgcaccgctgggatccgaaaacatctccggtcaagcattctgagtgaagacgaatcaataatggttttgcgggattagtcaaatccccttttgctaatactaagtgctcaagatgatgctgatcttcaaataaggttaaatcgaaggatccaaatgcggttggcaattgaacggttaactgacttgttgccatataagtcgctaactcttcgatagtgatcatcggcagctgccatttttccgcgaattgagccaattgtgggcggcgagccatcgtgccatcctcatttagaatctcacaaatataggccgcttcactttgattggtcaattttgctaaatccaatgcagcctcggtatggccccttctttccagcaccccgcctattcttccgatcaacgggaaaatatgacctggtttttgaaagtcctcttccttagtttgaggattagccaatgctcggatcgttcgcgcgcgttcttcagcagaaattcctgttgtcgttgaacggtgatcgacacttatagtgaaggctgttttgaaagtatccgtattttgcgcgaccatttcagttagctgcaagcggtcagctagttgagctgagataggtgcgcaaatcaaccctcgagcaaatttcgtcataaaattcacgctttccatcgtagctagattagcgatcccaacaaggtctccttccgcttcccggtcgtcatcatcagcaacaataattaattgcccatttcttaaatagtctaatgctgtttcgattttatttttactcataggacatttcctttcttccgccacggatcagttgattggctttgacatattttcctaatagatctgtttcaacattcactgcttcaccgcggttaagtcgccccagattggtttgatttttggaatgaggaatcagtccaacggagaaatagcgcagtgtggtctcgataatcgtcaaactaaccccattcaatgcgatagagccctgtggaatgatctcatttctcagttcgtcgggataagcaaatgtcagaatcagcgcattctccaacacacgcttttctagcagcgttgtcgtagtatctacatgacctgccaccaagtgtccttccaagcggccgttgaaagctaacgctcgttccaaattgacttcgtcattgatttttgcggtcgaaaaggtggttcgttgataagtttccggcatgatctcgacagtgaattcttgtttgccagtcttgatcgctgtcaaacatacgccattgatcgccatactatcgccaacccgataatccgttaacaatgcttcagaagcatgacaagtcaatgcaatggtgcgaccactaggcacgatccgtgtgatcttacccttttcttgaatgagtccggtaaacattttcctgcctccttccaacgatccttaactcttctccgaccggttcaacagtgacttccgttagcgcaaacatctgattcacttctcgagaactagcaaaactcgctgttccattgccgccgataagttttggcgaaagataggtgataacttgatcccaataaccatccgccagaaaggcatcatgaatgctgcttccgccttcaacataaaccgattgaatcttgcgtcgatacaattctttcatgacaaacgagagagtcagtgaaggcgtggtaatgatattcacgtgatttgagaaaacagattggacttttttcgtagtaaagaccagtacaggactactggtatcctcaaaaagagttagctgctgtttcaaggtttctcctttacgatctaggaccactcgataagtcggaaaggcagcctctgtccgcaaagtaggattatcgattaaggcagtgcggctccctatcaaaatagcctggtagtctgaacgttcctgacgaacccggcgcaatgcagcttcaccggttatccttgttcgctgaccagccaaagcgatttttccatcaagtgtggttgcttgctttaaagccacaaaaggacgttgctcttcgtgatacgtattatagtggcgattgatttcacgtacctccttttctaaaacaccggtgatcactgctactccttgtgattctaaaaacgctttgcccttgccagataccaacggattgggatccaattgaccaattaccacttttttgatgccgctttgtagaatagcagttgtacaaggtggctgttttccgtaatggtggcaaggctcaagggtcacataaatggttgaatcaattagtttttcgggggaactacatgaatcgatggcgttcttttccgcatgtggctggccataagccatgtggctgcctacagcaactatttcctcatctttcacaatgacagcaccgactaaagggttcgtgaaggtttgtcctttgccttttagtgcttcggatatggcgcgcttcatatacgtttcatgcataaacattcctcctttctttaaataaaaagacctcgtgcataagtacacgaggtcttgattagacaaactcaaagaaacgatgacaaaaagaatagactcctcccgtcaatattcttgtaagtttttcttctcccatccagactttaactgtcggttccagagtttcactggatcaaccgcacgaatgcgggtcacggacttcaagcattgcttgtcaccgtcggtcgggaattacaccctgccccgaagaaacatattcaattcacgttagatactactattttttaattcaggtgtcaaacccctcttctatcctttttaaataacaattaaggaaaatgtttaagtacaacattcgccgttatcggagaagactttaaaaagttttttaggaattagcgacctccaaacaaacaattaaatgaggttccctggataaattatttctctttttatattttatttatttcgattgaataacacgtttttcgaacagataaaaaaagacttttaaagagtttaagaaacaatctctttaaaagtcttgtgaatggaataaatatgttattttgctgtagtgaaataaagtttctgactcgttaagttttccaaagaaagcagaaagaaactggcagctaataaattggcacttccgccgggtgaaacattttgctgttgacaatagttgttcaatgcttcaaaagcggcgctaggaatgggctgtttattggcttgctccacaatgccgtcagaagtactaaagtattctttatctaacaagttttgattttgataaatgtttcctactacctctaatcggtttctagcactcatcaactctgtatcataaatatgcttccctttgattctatatgcaccgctatcgattctgtatacttgtacatagctgtgccagtaagtatcactgtaattaacggatgaacttgtatgcaaaagaacatccccctcaaaaatctccacgccgttcttgtctttcaagccagtggattgcatgaggaatgaatcaattgctggaaaagtatgatcttctggataatctccgcttacatcaagtatgtttataccgtcatcatctaactcaaaacaaacgccttctgtacttggataaatcattctgtcattttctttatcccacgctctaaattttggtaccatcttatccctcctgctccaaaggcattatttcaatttgtgtgaatgtatcctttttttcttcgatttctttcgccaacttcttcgcaagttttaaactctcgcaaacctttttcagttgaactctcccagaaaatggattctcaacataaactaaatacacaaaactattcttagacatcttatccctcctgtttgctatcgctgacgattgcggaaatttactactatcttttattatttaccgtcttgcaatactgtaagggttgctaactttccttaatgatataatttgattattaattaaaaaggagtctttttatggacaaagtaaaagaagtagtttcagtaatactaatatttgctttgatatattttttgttgtgtctcgtcgcatctctcataatcagtttttttagattagtttttaaaagagaacctttctttgtaaactttaaagaattgtttcttaacttgtttttagaaattttgaatccttttaattatctgttctgattaaagcatttcgtcggataactgacttggtaaaatataaaatatgttacaatacctaaaaggaggtattgctttgggaacttttttagcttttatttggtatatttttataggatttatgctttatggaatcatcagattggcagttaaacacggaatttccgattccaaaaaaaataatttatgattctgttgctactcttttagagtagtttttttatttccgcaatttttggtggataactgactaaaccagcgatccgtcaactgccaataatgtcggttcattgtcattaatacaatcaaaaacttgcacctctgcctcttcactaccgactggctcccctgtttgttcactcactgtattcgcaacttttgtaatggcaactgtcgtctcaagttctttcatactagctacaaagtcctctttatcttctacgtcacacactacttcttcataaaattccatacattttccctcatttcagctgctacaattgcaaaatatggctcattaatttcaaaaaatctcatttttcatcttcctttctagttgtgtatttctgtcgttactaaattttcatatctacaaacatttatagtatttatttattttgtttgtttattatggtactttatttaaaaggagtgattctatggcgaacaatattgaatttgaagttgaaaaagtttataaaggcagaaccaacgaaatctttgttattactgatcccgagacacaggtacaatatattcaaacaattgttatcggttctgacggaaaaggcgtcgcaattacaccaagactagagccagatggaagtattcattataaggattaattagatcaacttgtgttggtcttttttctttccaagttggtaatttcttccaattgctgactaacgaccgctaacgaatttcctcagactatgcagacctctgccacgtcttttcgatttccgatcaatccaagtaccagttgttccccaataatcaatcatgccttttggcgtattgatcgcaaattgatgattattggataatgggtaaactcaaaacccaaagacttgatattttttatcgctgaatcgcccatgcgcttaacatgctgctttctacgctctttcaggtaaggcttcgcatctttccagtattcagccatttctcccataaaataccttctttcttccgattacaaaccccttatttagccaaaatcatatttttcagcttaacaacagtttgatcaccaagaactttctgccgccactcgtcctgttctttgtgacagacaataattctcacatgtgccgatttctcataaattttcagacattccgctctaaccaattccgaaaatccttcgatggcacagttgtagatcttgccgacttttactttcgtttttgctggtctgaccttcggttgaatctcgaagcgacgtccttctggatgaataacaaaagagtcttgtaatctcatgatttttcctcataaaacttactttcgataaatagtccagtttttcggtcatatttagccaaaatcaattcgatttggtacctaaaacaaaatagtttagcttttattttaaaagcctcagtttgaactcctttaacatcaaccgcttggaccaatttgtttccatcccaaaatgtgaagtccggagtataagtgattgaacgtatggttttattccctaagcgaaatttgggttgaagctcgaatttttcttgtaatcgaagttcaataccattggtttccgcatatttagcagcgaatggaaggtatcgtgcttcagcaacactatcgaatttaatgccattgacaacagtttttcgattgctgtattttggtttcttggatagtttagttgctctcataccgccacaccctctcttgccatcagtcctcgatatagcaacttggcttcttgccacattgattcagtggttccggcagtgagaaactcgccatagtgcgtcttcgatacttttcccaagctgattcgagtgtgacgatacattaccatgaagattcgaaagcggacctcttctggctgatcgctgtcgaggattcgcttaacattttccatcaagttcttgtgactagagtctaatgcagcgtagatttgcttaattacagtgattcggtttaattgatcaatttccaaatggatcatcccccgcttcttttcgtagtcgttccatgatctcagcttccttttgagcgttgtattcttctggatcattaagccattcaggtataggttctgtgcgaattggcttcttagaatagctattttggttcttgtgccttacatcatctgctctaacatccgccatagttttgatatttttctttacccagctttgcataattcctttggcatatccgtatgacttctggtctatagcagaccgtctcatagcctcacaaaccatttcttcgccaatatcctcaacccaatgacgtagatcatcagcaactaatccgttaatcactccaaagacttcttgatagagctggaaaggattagcagcagccggagcgctctgcgcattctctgctgttgctggtgatgttgttggtgttgttgctggtgatgatgctggttgcgttatcgtatcgataccatatccataccctatcgatacggtattttcttttggtttcaaagtttggatagggtatttatattcttgacacttcttgatgacctcaatctcaaattcaagtgtttttatctcctttaattctttgtcgatgaccgctgcgactttaggagatctggcgctgttgtatttgagccagttgactatcatcaactcttccgacttttcattaaagacgattcggccttcgctaacgaggaagtcaatgtttgtttttatttcttctgcagtcatatctagttcaaacttcgcatatctcagattgaattcataaacaccacattgagttgtgtaatcattcgataagagatataggaaaaaaagtttttgatctttgctccattcaccgactcgtttgtctttccaaaaagtggtatggagttgtctataaatagccattctttaagcgactcctccttattccaataaatcgcctacttctaaaaatcctgttaaagacttatgttggcgacagtattcacatttcccgcacattttcggcgcttcttctccatttttcactcgtaagatatgaggtaattcttgttccaataatcgaagttcaaaatcaaagcgtccaggataaatactgataccagcaatatcaggaggcgactcttttgttactgcaaagatataaggtgtaatttccctgttataggtttgttcgagtaagtttttataaacagccatttgtagaatatagccatattgctcaacaaacgaaacgtagccactatatttttgtgaccagtatctctgagaaagactccgagtcgtttttaaatcaacaagataacctttctctaaattgaaacaatcaattctggctttccattccgtatcaaatagcgttcctgttagaatcagttctttctcgccttgatagacaaaacgaaaaaatcatcatattctaaggtttcaatcatattgatcgcctgagcaaactctgcccgttctgatccattctttttataaatagcacttgcattctcttgtataaattcttgatgtgcctcaggagacttaaaataagaatggacatagtttccaactagtaaagccgtaggatcactctctggcgaccattcttcttttaattttgccaaagtcgctgcttcgcattcttgaaatgttttgaattggctgactgacatatactgccagtcagcttcattgctataatagttcttcttgtttaagtccatcggtatccgtcaccttcgcttctttcaaaggatctttctttgtttgagaaaattcttgttctagtttcgacgattctttcttttcggcggtcggaacctcaaaccaatcttctactttactcatgccatgagtgttgctgattactttgattattggtttgaaaactacgttgaaaaaagctaaaatacaatactcagaaaaattatctaaacatcattaataaatacattaaaccagaaataggcaagtattacttgagctctatcggcccctctcgtcttcaagatttaatgaacaagttacccaatggatttgaccgccctcttgctaaacattccgtagaaattgtacttactgttttaaaaggagcatttaaaagagctgtctatccatggcaagcaatcaattcaaatcctatggtatacgttgaaatgccagccttcgaaaataaacccaaacaaacaagggatgacatgaaaattatcactatggatcagtatcaaaaaatacttgaatttaatcccccatccagtcctttcagattaccactcatgattggctttcatacaggattgcggagaggtgaagtatgtggtctacagtggtcagatatttctttggatgagcgaacaataacagtagatcgaataatgttacaggacaagcatggaattcagcttggcactcccaaaacacaagcaagtttcagaacaatagcaattgatgatgtattagcagctgaattaagaagagcaagaaagagtcaatcagagaataaacttaggtatggtaaattctattacgattcaacttttgtctgtacaaaagacaatggcgaaccagtgacaccaaattctattaaatggcactcttctcgaataaaaaaggaactcggaattgattttaattttcactctcttcgacatactcacgctaccatgcttttagaagatggagtcaagccaaaaattgttcaagaaagattgggccattcaaggattgctactaaaatggacaaatatgtccatgtaactagaaagatgaaaacagaagccgttgatatattcgcccaacgattgaaaaaatccgctgaaagataaaaaaattgtcacccatttaaatttatgggcgacaatcgggcgaatgtttttgaaaattcacaaagaaacaacaattgttttcaagaaccccttgctatttcttcggttcatcctcatccattttcagaacggccatgaaggcttcctgtggaacttctactgaaccgatttgtttcatgcgtttcttaccttctttttgtttctctaggagtttccgtttacgagaaacatccccaccataacatttcgctaaaacatttttgcgcagagccttgatatcggagcgagccacgattttttggccaatcgctgcttgtatcggtacttcgaattgttgacgcgggatgagttttttcaatttttctacgatggcttttccgcgttcgtaggcaaaatctcggtgaacaataaagcttaatgcatcgactttttcagcgttcaacaagatatccattttaactaacttgctggtacggtaaccggacatttcataatccagtgatgcataaccttttgtgctggatttcagtttgtcaaagaaatcaaagacgatttcagataatggaatttcatagacgacattgacccgataatcatctaggtagtccatggtgacaaaatctccccgcttacgctgtgagagttccataaccgcacctacatagtcatttggtaccatgatttgtgctttgacaaaaggttcttcgacattttcaatagtacctggttcagggaaatctgctggattatcgactgtcacggttgttccgtctgtcttgttgacatgatagataacagaaggcgctgtcgtgatcaattccaaattgaactcacgttctaaacgctcttgaacaacatccatatgcaagagacctaggaaaccacaacggaaaccaaagcctagcgcttgagaagtttcaggctcgaattggagtgccgcatcattcaattgcagcttctctaatgcttcccgcagatcattgtaacgagaagtatcgattggatagagtccacaatacaccattggattcatttgacgatacccttccaaagcttcttgggctggattatttgctagtgtcacagtatcccctacttgtgtatctttcactgttttgatagctgctgtgatataaccaacatctcccaccatcaatgcatcccgttggatcgctttaggtgaaaataccccaacttcggtgacatcaaaggtttttccattactcatcatttgaattttatccccaggtttgaccatcccatccatgatacggacgttcagaacaacccctcgataagaatcgtagacagaatcaaagatcaatgctttcaatggcgcttcaatatctccagctggtgccggtacatattcgacaatttgttctaagatatcttcgatgccaattccggctttggcactagctaaaaccgcttcacttgcatcgataccgataacgtcttcgatttctgtacgtactcgttctgggtctgctgctggcagatcgattttattgatgactggtaagatctctaagtcgttgtccagagccaaataaacattggctaatgtttgagcttcaatcccttgagctgcatccacaaccaatacagcaccttcacacgcagccaaactccgcgatacttcataagtgaaatccacgtgtcctggtgtgtcgatcaaatggaaaatataggtttcaccatcttttgcggtataattcaactcaaccgcattcaatttaatggtgattccccgttcccgttctaagtccatggagtctaataattgattttgcatttctctggacgttaccgtatgagtttgttccaaaatccgatcggctagcgtagactttccgtggtcaatatgagcgataatggaaaagttacgaatcttttcctgtcgttttttcatttcttctatattcatggatacgttcctcatttcttttagtcagcttttctattataccaacgaaatgctgataattaaagtatttttcttgaccgatatctaaacaaatttgttcaggttttgctatactatagctagtaaataaattggagttgaaagaatggacaataattttcatcaagatttgcatattcgaccagtagaagaaaaagatgtcgatcagttcaatgagcttctaagctatgtttttcaaatcactgagtcggacatcgaggaaagcggttatgaaagcaagcgtgaaatgatcaaatcaaaacgaccaatcttggaattatctaaagtgttcgggtggttcaacggtgatcagcttgtttcacaaattgctgtctatccctgtgaagtgaacattcatggaactctttacaaaatgggcggcgtgaccggtgtcggaacttaccctgaatatgcgggacatggactgatgaaagacttgatcaaactcgctcttgaaacgatgcgagcagatcagcaatggatctcttatctctatccttataatgttccttattatcgtcgtaagggctgggagatgatgtcagataaattaaccttcaaaatacgtgatacccagttaccaaaaacggtggaagttccagggatcgttgaacgaaaagaggtagatgatcctgacgttttcactgtctataatcaattctcaagagaaaatcatggcgcattacagcggaccgctttccactgggaagaatactggcgctacgaaaacgaagaaagccgaacagcagctgtctattataataaaagtggtcaccccactggtgtgcttttttattgggtcgccgaagaagtctttcacgtaaaagaaatgttttacttgaatcaagaagcccgcaatggattatggaactttatctcggctcatttctctatggtctactgggtcaaaggcgatatctataaaaatgaacctttggctttcttgttggaagacagccaaatcaaagaaacgatcgaaccttactatatggcacgcatcgttgacgtaacagagtttttgaaaaaattcccctttaaagcattcgatcagccttttcatttcgttgtctccgatcctgttgctgaatggaataatggtatttttggattgaactatgctaaaggtgaagtcatcgtttcgaatgatccgatcggaaaagcggtccaattagatatccaaacgttaacttgcgtactgatgaattatcgaagacctgcgtatttggctcgaatcgagcgtctccataccgattcggatacgttacagttattggagactattattcctgatatggaagcttattttggcgactatttttaatcatgttgataaaatgaaggagaatgaaaatgaatatttactttgcagcccccctctttgctaaaagtgatctgctttataatgccgatctagtcaatcaaatccgaagcacctatccacaagcagatatctatttgccacaagaaaatgcatccattaatgataagtctgcttatgctgatagtaaaatgatagctcaagctgatacagaaaaagttttggaaagtgacctaatgattgcattattagatggtctaacgatcgatccaggcgtagcttcagaaatcggcgtggcttttgccaaagaaatccctgtcttagggttatatacagacagtcgccaacaaggagcagataatcagcaaaagattactgcactgaaaactgtagccgaaaatcaatttcattatttgaatctctatacagtcggtttgatcaaactgaatggagagatctattcttcagaaaacgctttactagaaggcttggctgcctatctcggggaggaacaataaatgggtgagaattataaacgtttattaaaactatttacactatttggcttccttgttttcgcattttctgtttgggaattctttcgaggtgtctatcctaaacagcaagcactgatttttctagttcaagcattactaggtattttgttgatctatgtacctgaattcagtaaaaagctgttccgtattcaactgcccaatgcgactatttacttttattggttctttctgttgatctcggtctttatgggaacgattttgcatctgattgaaattatttccttctgggataaagtactgcacacagttagtccgatggttctgacagcagttggttatgggctgatctgtatgttcctaaaagatgttccagtacgagaagtttctccatggctttttcttctgatgggatttgcttttgcaggcctgtgtggtgttttttgggagttctgggagtttatctgcgattcgcttggtggaatgaatctgcagcgctatgcgacgctagaaggcaccccattcattggccgcgaggcattgatggatacgatgggtgatcttttgaccaacacgatcggagctgtattgatgggattgattgcttacttccaagggcgaggcaagcctgattattttgaaagctatcgtatcaaaaaaattgaacagtgatttttatcaactgtctgaactaataaaattagttcagacagtttttttatccgaatgatttcgcaaaaactaattttgacaatgatctttttttagcaaaaatctcccaaattcattgaacccgctttcattaataaaggaataaacgttatttaataatttatgttattggacgagtcctctttataccaataattgcaaaaagaattgcctgaaatgcagtgtatttgatttcacgattttcaaaaggtctgttataatatttaacaataagtcgacctggaagtcagtaaggagatcgccatgattttgacggtattttttcttttgtgctgcatgatcttttcatctattacctatgccttttctaaagatgcacgaaaattcgtccaacccctgcctattaaaatcattttcattgcttctgcggcgattgccgtttggacaatgttcttttccgtgattgcgctagtagcttgggtcgtttaaaaaagcattcttgcatgtttcgagtgaagactcgctcctgtgcaagaatgcttttttactgtgcttttaaaataatgaaatttcacttaatggccagtaacgcaagataacttttccttgcatttgatcggcatccaccacaccgaaagaacggctatctcttgaaatcagacgattgtctcccataacaaaatattttcccttagggacggtaatagagaaatcttcagtgaattgggttgcactggccgcgatttgctggaataattcccggtagctatattccttttgcaactgatcatccgcaaattgcttcttaaaatcttctaagtactcttcgtgatactctttgccattgattgtcaggacgtcatttttcatctcgattttatctccaggcaaaccaattaggcgtttcaccgcaattttactggtatcatccggttctacgcaaataatcacgtcttgccgctgataacttgaaatcttggaagcaatcaagcgttgcccatcagacaaagtcggatccattgaatgcccgctgactttgacaggcgttaaaataaacaatcgaacgacaacaatcaccacaataaaagcgagaataaaccaattctcttttaaaaatttctgcatcttattttatttgctccttcaactattttctcagtagatccttcattagaaaatagacctgcgttttgcgtttacttctcaatcttacgtttaatttgccttttcggcaagtaaaatctttttacgaaagtttttttttaggagaaatttaccaatctttgtttaataaaaaggaagttcttaaaccacattgacgtagcataataacatgatgatttttttattcaaaagaaaaaacctgaaaaatagcggaataggcagaagactttattcaggtctttcccacagtatcattccgtctatcattcaggtaattcaagggttatttttctcgtttaagttagatgactaagaaatctcttattcacttatcggtgtattttcaaaaacaagctggtcattcaacacttctatcgtcacttttgttttcggcagaacacgtcctgcaacgatttctttagccagaggtgtttctacctcccgtgtaatgaaacgtcgcaatggtcttgcgccataagcgggttcgtacgaatgctctgcgatccattttttggcttcttctgtaatggataattgaatgtcttgattttccaatcgttgagacaattgagcaataattttatccacgatacctgtaacattggctaggcttagtggcgtgaacaaaattgtatcatcgatacggttcaagaactctggtttaaaatgaccgcgtaatagcgaacgaacattttcagccaccgattctggaatcgttccttccccagtcacaccatctaatagtatttgcgagccaatattgctcgtcatgatcaagaccgtgttcttgaaatctaccactcgaccttttgaatccgtcaatcggccgtcatccaatacttgcaataaaatattgaaaacatctggatgggctttttcgatctcatccaataagacgatcgtataagggttacggcgaacagcttctgtcagttggccaccttcttcaaaaccaacataacctggaggtgctccgactaaacgtgacacagaatgtttctccatgtactcactcatgtcaatccgcaccatatgatcttctgaatcaaacagattgacggctaacgctttggctaactcggtcttaccgactcctgttggtcctaagaataggaaagaacctaatggtcgatttggatcttggagacctgcacgggaacggatcaccgcatcacttactgcatcgactgcctcgtcttggccaatcacgcgttgatggagtgtttcattcaatttcagtagtttttcccgttcgccttctaccaatttcgcaaccggaatgcctgttaggcgaccaacaactagtgcaatttcgttttcagtcacagattcttgcaccattcgaacgccttccgcttggttttttgcttccaattcggcaagttctttttctaattgcggaatcgttccatggcgtaaaacagcagcgcgctctaaatcataattattttcagcatcttctaattcatgtttggctttgtcgatttctgcccgtttattggaaaccgcattgacttcatctttctcagtttcccattgcatcttcatggtattggcttcttcccgcaaatcagctaattcttcttgcaggtttgccaaccgttttttagaagcatcatccgtttcttttttcaatgcggcttcttcaatttccagctgcattaaacgtcgcgtgacttgatcgagttcagttggcattgaattcatttctacgcggatcgttgcactcgcttcatcaatcagatcgattgctttatccggtaaaaagcgatctgtgatataacgatcggataatgtcgctgcagcaactagtgcattgtcatgaatgttgaccccgtgatggatctcaaagcgttcttttagtccccgcaagatcgagatggtatcttcaaccgttggttccttgactaaaactttttggaaacgacgttccaaagctttatctttttccatatattgacggtattcgtccaatgttgttgcaccgatcgtatgaagttcaccacgagccagcattggttttagtaaattaccagcatccatgctgccttccgttttgccggcacccacgatattgtggatctcatcaataaataagatgatccgtccttcagatttcttgacttctttcaagaccgccttcaaccgttcttcaaattcaccacggaattttgctccagcgatcaatgcgcccatgtctaaagagaaaatcgttttgtcttttaagttttccggtacatcttttctaacgattcgttgcgccagtccttcaacgatcgctgttttaccgacaccaggctctccaatcaaaacaggattatttttggtttttcttgaaagaatacggatcacatcgcggatctcttcatcccggccaatgatcggatccatttttccactgcggacttgttgaacgaggtccacaccatatttttctaaggctttgtattgttcttcttggttttgagatgtcacacgttctccccctctcaaagattcaatggttgcttttaattctttttcattgattccttgaccttttaagtaattggtcaatggatggttttttagtttcattaatgcgagtaaaacgacttcagtcgataaatactcatcattgaaccctttttttagttggtctgcttcagaaagcaaacgaaataagttttgactcatgctttgtccgtattgaacattgccaccttcaacagatgggatttcatccaatagtcggtcaacttccttctcgaaagcatcgacatcaagaccagcgtccgtataaaaattgcggccaaattgattggcttgcaataaaattttccataaatgagcgatatctatctcctgatgatggcgtgttatcgctacttgttgtgcttctgcaatggcactttgtaaagttgttgtcattttttctgggttcattgttctacctccccgtcatttctaggatttctcctacattgtagtataccattttggtcagtaatggtcaaaagatatgcaagcactttttgactttcttttttagcaaactatcagcaaaagttgacataaggaaagctaagatggtatgcttaatgaaccatttcaacggaggaaaagcagatgtcacgctactattttaaatttatctttaaatttatcagaaaatctgctcttaacaagaacacgatgaagcattgttaagagcctacaagcgcctagcgcatctgcttcatcaaagactcggagtgaggtttctttctcatgccctggtttttggtggatactaaaaagattgtaagctgtagacaatgactgtctatggcttttttatatggaggaagatcatgttaacactatcaaatctatcgcaacaattcggcgacaaaatcttgtatgaagaagtcagcgttcaaatcaatcgtggcgagaaagtcggactgattggacgaaacggtgccggaaaaagtaccttgatcaaaatcattaccggggagattcttcctgatgaaggccaggtcactttcccaaaaaatctgaaaatgggctatttggatcaatatgtcaatgtggacgaaacccaaaccattcgcgatttcttacgctcagcctttgctgctgattttgaaaaagaggcaaaaattgcttcactatatggtgaatatgctgaaacattggatgatgagttacttgaaaaagccggtgaattacaaaatcaattggatcaaggttccttctatcaaatggacacactgattgctgacttagcggaaggtctgggcattgccattcttggtatggaaaccccactggtcaatttaagtggtggtcagcgatcaaaattaatcttagcaaaaatgttattggaaaaacccgatatgctgatcttggatgaaccaaccaatcacttagatgatgagcacatcaagtggctggttcaatttctccaagatttcaatggcacctatttggtggtttctcatgaccaacagtttctcaaccagatcacgacgcatatcattgatattgaatttggcaaattaacgaaatataccggcaatcttgaaaaatcactgaaactcaaagcgttgcaaaatgaaagttatttgaaacaatatgaagcccaacaggcacatatcaagaaaacggaagcctatattcgaaaatataaagcgggctctcgttctacgatggctaaaagccgagaaaaacaattagcgaaaatcgaacgattaacgccaccaacagatgcgccgacaccgcatattgcttttccttatgcccctatcgtcacaacattggcgttggaaacaacacacttagaaattggctatgacaaaccgcttttgtcaccgatcgatttgacgatacgctacggtgaaaaaatcgctattcgcgggtttaatggaattgggaaatcaacgttgatcaagacactcttaggtcagataccggctatcaatggatcggtttcatttccccaacacacaaaattcaattatttctcgcaagacttaacttgggaacaaccattacaaaatcctttgcactatatgagcgataaatttcctaaagctataatcaaagaactacgccgccaattatcccgtgcaggattgccgagtcagctggcacaagaagcgctaaaatcattgagtggtggcgaacaaacaaaagtcaaacttgccgaaatgatgatgatcaaaagcaattttcttctattggatgagcctactaatcatattgaccaagcaaccaaagataatctgaatgcagcactggctgattttcaaggaactgtcttagtggtttcccacgaagccgatttctacgaagactttgcagatcgaattattgaattaagtgaataagtacgacactaaaaaatctcgaagaagtgccgaaatttcagcgaactagctgaagtttttgaggcatgccttcgagatttttttgatttagatttaataggagaaagaaaaagtttcattcctttgctcacgctttttcgttcttcaactcttccaactcagcactcatggttttgcgtttttccaaaatgacatagacgaaaccgatcacgaatggccaaataaaagtagcaaatcgataaagcaacatcgatgacgctgcatcaacagtccctaccattggtccaaaaagtaacatataaacaaattcaaacgaaccgattccagccggcgtaggaataacacccgataggatcactgcaaagctgacaaaagaaagcgtcagtaagaagtcgatttctggatgtttaggtgccaatactacataaggaatcacataccaagcagccaatttaacgacattccagaaatagatccgtaaaaaagccgtacgatcacggagaatcgaatagactgtctcccgtaacgagtaaatctgcgtattgcaagtatcgatgattttgcgcatgctcttacttttgaaaagtttgtcgctgattaccacaaaagcgacttgaacgttgacacttacagaaagtgcaagtaaaaaggcaataatcagaaaagtaacgaccataccagctaatatcacccaaatcatatttggggctttctcaaagaataaagaaaattgaatcactagccctgcgatagcataagtcaagaccgccaatttatacatgaccatatgcaacgtagtcacacctacaccttgtgacaatttcaatccatttttacgataaaaattgacttctgatatcaacgtcccagcaccaaaagtaataattcgatagaatccagagtaacaaacggtaaataagccgtctttcgttgtaaactccggttgaaatcctacagcgatctctttgacggaacgtccttcaataaataagtaaattgttcctaacgccatcactgctgtaacgatcgacagactggtttgtcttaattccgccaaaatatcagtcatagagctgcgaataaaatagtacatcgcacctaagatcacgaccattaatagcaggtttaaggcaaatttcacttttgctttcatttttaactccttaggcaaacttaataaacaatagaagatctacaatcacaccgaaagcaaaaaaaatataaaatttacgtttgcgtgttttatggtgaaaaacgcgttgcgcgatcaatccaccgattccgccgccaatcaatcccataaacaacagattccattcagggacacgccatttttttcttacggcttggtatttatcataccccatcaagccaaaaagataaagattcgctataagtaaataaaaccacaatggattttgtataaattctgtcatcatttctcctctggttgatattatttagcatccaagtcttcttcttgaacacggacacgaagggcctgtttcatcaccttcattttaacaggcagattatctgtcggatcgccatcagttcgtgtataaacagttttttcctgagcacgaatctcaatttcatttgcagtaaagtactcgacacctggcactttcgcaatatgaccacgtatgatccggggcaaataaataatgaattccaatagattgagttttggcaataaaatcatgtgaaacagcccgtcatctggtcgtgccaactcgtcgaaattggtaaatccgccagctgaattggacatgactactgttaacaattgactcttgccacgccagcgttttccgtctgcaataatttctaatttgtattgtttctttttgaataaataatggaaaaaccgcttggtaaaagcgagtggtccgaactgttgtttttcttcttgcgaagtagccgctgccgtatcggccagcaatccgatggtcatcgtcgagatcatcatggagtcattgaccaatccataatcaatttgtcgatcagtcccattcaatatcgtttcaaatgcttcttcaggtttgagaggaatccctaacatacgggcaaagttattgaccgttccgcctggaataattgccactgtcagcttatctaactgatccacaaatgtttgcagcgcatgatggattgtaccgtctccaccaatgattgcaatcgtatcgatttgatgttctttcgcatttttttggattgtttccggctcaatatcaggattggaaggttgcaagactgcttcacttttaggatcatgttcttctagatagttcttaaaagactctgcagtatccttggcatcgcttttaccagccgtatcattatataaaaccatgatcttcatatttttcacttcctaaataaaatagggctgcgaatggtgcagacttctgcatcaagtctcagcccattattcaactcatttttcattatcaagcgatatttttccacttgaaaacgaaacaaaataaagttctactgtgcgtttttttcggcaatcttcacgattacatcagttgcttttttcattgattccaaggaaacaaattcatagcgtccatgcatattttcaccaccggcaaaaatatttggtgtcggaatccctaaataagagatcttcgatccatctgttccgcctcgaactggttcgatcactggctcgatacccagatcttccattgcagacttagctaactcaataatactcatgtctttttcaatgatttctttcatgttgtaatattgatcatataaatccatttggattcttgcttcgtcaaattgggcattcattttttcttggattgtaagcaattgttttttacgattttcaaacgtttcacgatcatgatcacgaatgatatacgccatttttgcttcttcgacggttccgttcaacgccatcaaatggaaaaagccttccgcaccatcggttttttctggcacttgatctgttggcaattgattatgaaaatcaatcgccaattgcaaagcattgatcatcgtatcttttgcggttcctgggtgcacatttttcccttggatcgttagttcagcttgtgcagcattgaaagtttcatattgcaactcacccactggaccgccatccatggtataagcaaaatcaacattgaaatcagccacatcaaatttatcagcccccaccccaatttcttcatctggtccaaaggcgattttgatttctccgtgtttgatttcaggatggttaagcaaaatttccatcgccgtcaaaatctctgcgatacctgctttgtcatcggctcctaaaagcgtgctgccatctgtcgtaatcaatgtttctccacgataatttttcaaattaggaaagtctttgatattcagtgtaaatttgccctctttatccaatttgatcgttgactcaccgtcatagttttcaataatttggggatccacattcaccgcgttaaaatccgccgtatccatatgtgcgataaatccaatggaacgaactggttcggaaacattacttggtaacgtaccaatcacaaaaccattttcctcattataatggacatcatgaagtcctaattcttccatttctttttgcaatgtcttggcaaacgccacttgcgtttgtgtggagggtgttgtttggcttgtcgcatcagaacgagtttccgtctttacatatcttaaaaaacgcggtaataaattttcgtacataattgatcactcctatttatattggaatggatttgtggaagtctctgaaggaataaagtctacctgccaaccttcttccgctttccattcattgaattttttgataaaacgagggatacattcccgttcaatgttatgacctggatcgattgccgtcaagctgtttgcttgtatatcatgagcggtgtgataactgatgtctccagtaatatatacatctgctttggcattcacggcttcttgataaaactgttcgccactgccgccgcatatagcaatccgttgaacgttttgccgctttgcttttggttcgatcaaacgcaacccctctaactgaaaaacacttttgatttcatcgatgaaatcttccaacaaaacaggtgcttttaattgacctactcgcccgatcccataatgctgagacaagttatccaaggaataaaggtcataggcgggttcttcatagggatgcgcctcaaccatcgcttgcaacaccttttcggtgatggtttctgggaaaatcacttcgatttttgcttcttgtaccgactcttcttccccaatttcaccaatcgcaggatgcgcatcctcttgaggagtaaaacggccggtaccaatcagtgagtagctggtgttttgataatttccttgctgtccagctccagcttttcctaaagctttcctcattgatgcgccttgctcaattggaacaaaaacagccaattttttcattttgattgtatgggtgggaacgagatacgtggtttcttctattccaagcatttcacaaaaccagtcattcaacccatcatgaataatatccatattcgtatgcgcagcatagaccgaaatattatgtttgatcagatccatatacattttttgttgcggatcatcggctctcaaacgacgtatggaacgaaaaatcggtggatgtttggcaacaatgaagtctacttgtttttcaattgcttctgcaatgacttctggacgaacatctaatgtcatcattacccgttggatctcgttgtccaacgttccgatatgcaatcccactggatcaccatcttctgctaaccattgcggacaatatctttcgaaacgttcaataaacgttctagctaacattattccagcacctccttgatccaatcaatctgttcgtttaactcacttattttatcttgaggaggaattgccgctttctctagttcttgcaaaacgatttctcgctgctgcaattcatgggcccattttttataaaaaacgagatttttttctttcaataaacacgggccaaaaaataattcttgtggtgtatagattttactgccttcttcagctacgatgatttcgtagtttttatggttttcttcaatcagttcttcgtgtaaaatcatgtaattattctcctgaagccattctcgcaaagtccgctcccccacattgggttgcaagacaaggcgctccttcccagtaattttctgctgagattttccattttctaaaattgttcgaatcaaagtgccacccataccagcaataaccaccgtatcaatctgatcatcaggttggattgcagctaacccatctgctaagcgaacagtgattttgtcgctcaagccattttttttgacttgccgtgaagcagattcgaatggtccttttacaacttcacctgctactgcatactgaattttattttgtagcatcaatgccacgggtaaataggcatgatctgatccaatatctgccaagcgggcttgatccggaatctgttcgccaacacgagtcaatcgcagggataatgattgttcgttcataacgtcactccttcagaaatagtatatcattctttattgcattttaaagggagagtttttactccttttatttacggctttacttcacctagagttgcttttgcacttttcgtaaagaaaacttgcatatcttgcttttcaaaccaatcgttgtgatccatatgaaggttactgcgctcccgtcacccagttgagtatcaatcgcagtgattcatacgaaggttactactctcccttcggtcgtctagtactgctcatcatctgctctgtcttgcttcgcaagccaatcgcagtgattcatacgaaggttattactctcccttcggtcgcctagtactgctcatcatctgctctgtcttgcttcgcaagccaatcgcagtgattcatacgaaggttactactctcccttcggtcgtctagtactgctcatcatctgctctgtcttgcttcgcaagccaatcgcagtgattcatacgaaggttactactctcccttcggtcgcnnnnnnnnnggtcttgaccgtacggtcataggagccgttacgagaattacccgtgttaaaaccaatgcgatcatacttttcgtaatctaggaaagccgttaactccgttttgagaagcgtattgactgctttctccaaatggacacggaataattcattcaaatcgcctttgttcgctagagtctttagaatttctgtagtaaaatcgttcatagggaagtcctctcttctgtgaatgtgttgtggtaactctattctacagaagggacttccttttttctatttacacaaaatattttacactctcctgagttaaactgaatatcattctgtctatataaattttaagatggattaccatacttttgtttgactcattgacaaaaatctaaaaaacttatcctcagcgagattgagtgtcttttaccagacacaaatccctactacagataagttttttatttttttatgcttttaggcttttaggtatatggatatttcagtttttccttactgataagtttctgtccgcaagaattcttcttgctttaatagctcctcgatggaacaatttttttccaatgcttctttgacaaaagcagtggctttttcataaccaatttgcggtgaaagggctgtaatagtccctgtactgttatttacagctttcgaacaagctgtttcattgacggtaatacctgccacacatttatcggcaaaaatttgacacgctttggtcaacagttgacatgattcaaataaattatggaacatcaccggctcaaaagcattcaattccaattctccggaagctgccgcaaaggtgatggcaccgtcatttccaatcacttgaaatgcaatttgactgataacttctggaatgactggattgactttgcccggcatgatcgatgagcctgcttgtcttgctggcaagttgagttcatgaaaaccagttcgcggaccgctggctaagagacgcagatcattggcgcttttgttcaatgtgatggcaatcgtttttaatccacctgaaatcgaggcgaaactgtcggtatgctgtgtactatcaatcaggtcattcgctggccgtaagggtcttggaaaacgtcggttcaattcttgatagaggtattcttgatagcgataggacgcattaagacctgtcccaatggctgtcccacccatatttaaggtcaatagttctgccgataagtggtgcagccgttcacggcaacgcgtcaaactgtgggcatatgcagcgaaactttcccctactgtcattggcaccgcctcttgcagttgggttcgccccatttttgccacgtgctgaaattctttcgctttcatatgccatctgtcaatcaactgtaccagcgcttcatccaattgttcaatatatacaagcaaagccagtttcccagcactaggatagacatcattggtggattggctttgattgacatcgtctaaaggatgaagatattgatattcccctttcttatgccccatcaattctaacccgcgattggcgatcacttcattcacattcatgttggtggatgttcctgctcccccctgaaatgtatcaacaataaattcttcatcccacttgcccatgatgatttcttccgcagcagtcacaatgatttgtgctttttctttggatagcgtgccagattgttgattggctagcgcagctgcggctttgatacgtgctacttgtttgatcatcgtcagatcaactttttgatcagtgaaagcaaaattttcttttgcgcgataactatgaataccataataagccccctcgtatataggtagactgccaattgtatctgattcgatcctcatcatgatttaaacgcccctttttgtattatatgtgataaaatatcacataagagaaaaagacacgagccttttcagccatctctttgttaatccttgaaattgattcctttcactttgaaaaacaaagagaaacagtacaaaaacagaaaagaggaaagtatttggatgaactagataaaaagttgttgaatctgttgcagcaaaatggtcggttatcgatcaaaaagttaagtgaagcgttattcatcactgcacctgctgtttcccaacgaataaaacatttagaagaaaccgagcaattgttgtattatcaagcgacgattgactatgaacaagccggcttgccgatcaaagcatttatccacctgtcgatcgaaccacagcaaaaagcaagtttctatcctttcatacaggcgatccccaatgtgttggaatgtgattgtgtcaccggcccttattcaatgttaatcaaagtcgttttcccttctaccaaatcattggacagctttatcaatgacttgcaaaaattcggtcgaaccaacacccaaatcgttttctcgacgccagttccctctcgaggatatcaattctgaaaacccaaaaagcgcgcttatctcacatagacaggcacgctttttttatatacaggggtcactggtcatcgactggcacttgcaaccctcgtggtccgacattcgttgaaaatacaatgtgggttttggtatccccataaaattgcaaatctgtgataaaccgatccaagacgaccgtatcactaaaataaaccttcaagagcatagaataatctccagtgatacagtcacactcgatcacatttgggatgtctgcgatataggcatagaaggcttctttatctttggcattcactgcgcaatggacatacgctttgatcagataaccaagtttttggtagtcgatcagtgcctgataagaacggatatacccaagggtttcaaggttttgtacccgcacagaaacagatggcgatgaaataaagcattgctctgcgatctgtttgacagtgactcgggcattttgctgcatgatgttcagtatcttgcggtctaagttatccataatcatcccccgttctcattattttctcagtttatcgagaaaacaacagaagcgcaagttgcagattacatcctatgttaaatttcctaacatcaacgctgagataattggaaatagcgataaacaatcatcgccccacaagcaaacagaccacacccaaaaaacatcatgtcaaagccaaaaagactggcgatgattccccacaaaaaagccccacctccataagctacatctaaggctgctgaaaataccgctgtcccttgccctcgctgcgcctcagacaccgattctaatacaatcgtattcatcacaggcaataagccggcataaccgacaccataacaactcgcggccagaagcaagctactgagctgtgtcgtaaatggcaacagacaaaaagaaaccaaaatcaataataaactgccataaatcaatgtagccgtttggattttggcgagcaaacgtggaaatacgacccgtgttgtgaccgtcatgatcgacatgaccgtaaaataatagcctgcgccgataatctcacgttcaagggcatattgtgcaataaacgccaccacgccagaattggcaaagcatatcaaaaaaaggataccgctaggaaacacaaccgctttgatgcgaagcagttctcgtaacgatgatttcgcttcgccagagtgcgtattcctccgtgaaaagggctgttctttcaaaaagaaactcaacaaaaaagctgttccgctcaacaagacggccatccgaaaaagtacaggaaatccataattttctacaacagcaagtcctatcaacgggccgatggcactcggcacagcctgggcgatactgaaataccccaatccgactgctaatttgccttcaggaatcgtatcaactgccatcgtcgctgctgctgtcgcttgcaaactattgcccaccccttgcaagatgcgcagacaaaaaagcatcaatagcccctgcagcagattcaataaactaaaatcaatcaacagaatggctaatcccatacaaagcaagactttgcgtccatatcgatccaatgccacaccgattggcaaacggcaaaacaaagcagatagccccaagacacctacaatggcgccggatactgctttagaaccacctaaagaagcaacatataacggcatagtccccatttgggtcgtgatggctgtcattgctagtaccgtgaccaccatcactaagtaaaaatctttcgaccaaagccgactagagctgttcaccttttccatattgtgcctcgcttctatacagctaattgaaaacgtacttgtgtcaaaaattgctgtgtacgttcttcttgcggatcctcaaaaatttcttctggtgttcccgcttctaccaccacaccatccgccatgaatatcactttatccgcgacttcttgtgcaaattgcatttcatgcgtcacgatgatcatcgtttgcccactatcagccagttgcttcatgacatttaggacatcaccgacaagttctggatcgagcgctgaagtgggttcatcaaacagtaataattctggcgtcaaagccatcgctctggcgatacctacacgttgttgctgtccgccagacagttgactaggatacatcatagctttatctgccaaacccactttttctaaggcagataacgctgctttttctgccagtttttttgggaaacgccgtggtgtgcgtagtccttccgccacattttgcaacacattcatgtggctgaacagctcataggattgaaagaccatcgctgttttgcgggcgatctccaatcgttgggttttgccaatatgtgcgagatcatactggaagtcaccgatagaataactccccgcatcaggctgctccaacaaattcaagcaacgcaaaaaggtcgtttttccagagccgctaggaccaatgatgcatacaacttccccacgttcaatttgtaagccaacattttttaagatgacttgtttatcgaaagacttcttcaatcctttgatttctgcttgcagcatactcccaccctttcttttctatcgctcaaagcgcgatcgtattggcagattgtccttctagcaaaatatctcttgcattgttcaaagctgtttctgcaatttcttgtacagccaattgggtataatacgcaatatgcggggtcaaaagcacatttggcagttgattcagctgttgataataaggattttgatcccacccaactgaaaaataccgttcttcattggcgatagcgtctaatacagcaccagacaaacgcccttgcgcgagtgcggcaatcaacgcatccgtatcaacgattcccccacgtgccgtattgaccagacaactgccaggcttcatctgtgcaaaaacagaggccgaaaatagcccttctgatgcttttgtcagcgggatatggatcgacaagacgtccgatgcagcaatcaaggtctcaaaggacacatattcgacaatccccttcaaccgaggattttcactcctactagtggcaatcacatgtccccccatatgataaatcgcttctgcgactagagcaccgattcgaccagtgcctaacaaaccgactgttacgtcttgtagctcccgaccaatcacagaccgtcgatcaagttttcctttgatcattgctggaatattgcgtaaagccatcaagatcgacatcacagtgtaatggcccaccgatgttgggctataagaagggacattggtgaccgtcaactgatgcttttgcgcccagtcaaaacgaacaccgtcgacccccgttgatttgatcgataactgcttcatccctaaaatatgcaagcgttggtacaggcactcatcttgctgcatagccagactaggatacaaacagatgccgtcgtgccctgctgccaaatggatattctcccaagacaagccctccattacgatcgtcactggtgttttgtggataaattgccaccgttcgatataagcaatttcctcttcacttaccccgtaataaatcaatttcattggcaacacctcctaaatgaccccttcatatgctggcggcatagcgtattccaacgcatcacctaataaagcgatcccttgatcgatctgtgccaatgtcggcttcgtaaaattcagccgaaatgaatgctcatagccttttcccgcaacactcatgatattgcctggaatgaccgcaactttcgcctcatcaaggtaatcatagaaccgctctgcgtccatctcagtcgataggaaacaggtgataaaatagccgcctgttggtttgataaaggtaagcttatccgttggcagtgcctgtaatgcttgcagcatgcgggcatatttctcttgatacaacaaggtcaattgggccacatgaccttcgaaatcatgatgatccatatattcggccaataccacttgccaataaaaattggtgtgggaatcggaggattgcttggccaaaatcaatttttccattacaggaccagcagccatcataaaaccaatccggctgctgggtgccaaaatttttgaaaaagatcccgcataaatgattcgtccttcggtatctaatgttttcatcttagggatcggtgtaccttcatacaacaactcaccgtaaggatcgtcttcaaaaatcagcacatcatattgacatgccaatgcataaatggctttacgtttttccaatggcattgatgtgcctaaagggttttggaaagtggggatcagatacaacattttcactcttgcgtctgttttgaggattgtttctaaagcgtcaagatccattgattctgctgcaagatccatcggtaccggcactggtatcgccccatatcctttgatagcattcaccgcaccggaaaatgtttgctcctcgcataacaccacatcgccttcattacaaaagacttttaccgccaaatccatggcttgggtcgagcccgaaaccaccagcacctcctcttcgttatcgatatttgacaattgacgcaaacgttctttgatcaaggtccgtaagcgcggatacccctctgatgccccatactgcaagaaagactctgggtccgcttcgttatataatttttgcgagatctctttcaatgtagccattggaaatgcttctgtcggtggaaatccgtaagcaaaggaaatagctgctgcagactccatatttttttttgcattctctcttaatggagatgcttctaatgtcatgatacgttgtgcgaattgataggccattctatttcctccctacatagttgttagccggccagctgtgtggtaaagcgggctaaaaaggctttggttcgttcttctttggtttcctcgaatacttgttgcggtgtgccttgttcaacaatatgtccattctccatgaaaactactttgtctgctacttcatacgcgaatttcatttcatgggtcaccaataccatggtcgcaccggcttccgcaatttctctgagcagcgccaatgtctgtcccactagttccgggtccaatgccgaggtaggttcatcaaacaagatgaccttaggattcaacgccaacgcacgggcgatcccgatacgctgttgttgtccacctgacagttggctaggataaaaatcttgtcgttcagacaaaccgacttgatccaacaaagcctctgctgttcgcagggcagtttctttgctttgttttttggtcacgatcaatggcatcatgatattttctttggctgttttattttgaaacaaggcataattttggaaaaccatcgctgtttgccgttgatgggtcaatatttcttttttacttgctttgtgcaatgtggtggtggtttctcccaattgaatcacaccttgatctgctcgttccaaaaaattgagacaacgcaagaaggtcgtttttcccgaaccggaaggccccaataagacgactacttcgcctttagcgacatcaagatcaatcccttttaacacttcttgtttgccgaatcgcttatggatatccgttactttcatcataatgcggccctccttagtttgcgcaacagccgattttccagtaattgtgcccctttttcgatgaccaaactaatcagccaataaatgatcgcaacagccacatacgcttctaaaaaccgataattttgctgggccgtgattttagctgccgcaaaaacatcgacaacactgaccatggaagctaaggccgacgctttaaccaacgagatcagcaaattactgaacatgggcaatgaaatcggccaggcttgcgggagcagcacacgacggatgacttgtaagttcgtcatgccgatcgatttggctgcatcgaactgcccttttttgactgccgcaaatgcgcccctgaaaatctcgctgctattgatagcagacattaaactcaaggcggcgatcgctatccaaaccatgttgaaatctttaaaccgcaaagtccaatgcatcgactccgcccaaatatcaaactgtttagcagaaataagatataacgctaaaatcactaaaaccactgggaccccttttaagaccgtgacaatcacttgcagaactggtgcgaggatcttgatcctatacagacgaatcaaggcgatgatcaacccaaccaccgcgccaatgactagtgcggtcaacgccataaaaagcgtcgtaccaatataatgacttgctgttttcagcgcttcgatcataatagacaattgaaaactcatcgccattcctccctattctgggacgtaatccccatctagatatttttctgataattctttgatcgttccatctgctttcaattcctctaatgctgtattgaccgcatcaataaagtcttggtcagcttctttgttgaacaataagtaggcatctgagttgtggactggttcgctgccgatctctagattttcactaaatgaattgttccaattattgacttgatattctggtgctaacgttgcatcgaccgcacctgaagtgactgcttgtacgatttgctcgttgttgtattccccataaaccaattcaaaagcttcgggattttctgccagataagcctcagccattgctgcttggttagtagcagtcgtcacatagactttttttcctgctaaatcttcgaagctatcgtagaccgtaccggcatctgaatcagagacaatatacgtatcccagaccacatacccaacatccccatagacgaatttttctttccgttcatcattgacttcatattcataggcagccatctggactttattgctttctaaatttgataacgtcgttgggaaatccgctccttcaaaggtaaaggtataatcaagtaatttttcgtcgattgctttaacgacggcgacatcatagccatcatattcaccattttcgtctaaataagcatatggcaatgcttcattcccagtacccaccttgatttctgttgcatcacttgctccactgcttgcagtgtcggcagaactgcttccgcaagcccctaaaaccaaaagtgtcaccaatgtaattgcacctaaaatcgtttttttcatttgaattcctccctttccctctacccaaaattttcctatgttgttttgattttttgctgttttttggtccatgatatcagtggtacttttgctgtttgttgttttgttttcgaaaaactcatccgacgttccagaccggtgaaaacacgttctaagaggaagcttaaggtaataaacaagatcgccgcaccgacatagccttcaagtgtatggaaggtcactgcgcctatcgctcgcgctttgccgacaacatccactaccccaatggtaaaagccagcgatgtgtcttgcagcagtgcaatcgtagttgtaccaaatgcaggtaatgcgacacggacaacttgcggtaaaatcacttgtcgatacatttgtgttttcgtcaatccgcaagcaatactcgcttccttctgtgtgaccggtacacttagaatcgcagcccggaaagtttcagactgaaaggcagcagtatttaatccgtaggtgatatagatgaaaataattttattccatgaggaaacatcgatttgaatcatttgtaataaggcgggtacaccataatacacaacatacagttgaaccaatatcggtgtgcctcgaataaatgaaacgaagactgccgccagttgactcagaaatggcactttttcgacacgaataaatgcaagtaaaatccctaaaagcaatcctgtaatcgacgccactgctactatcatcaacgtaaccggcaaagcacttaaaacctttggaaaatattcccaaactaatttccactgaaaaaattccgacatattgcccctcctttttctgaatattctgattattagacaatattactaatggaaaaaaatttttcaatagattcattactaaaacttcattaattttataaattctcccttttaactaaaaaaagaaagatgcaaacggtatctttctttttaatataagaatataaaatactacccgtggtgctagttaattttttcctagaggaaaatgtctaaacatgttggtaaatcaacaaaaaaacgcatatagtagtctcaaaactcccaagaaatgaggactatttaacaaactacgatggttacgtcgtgacaactgaacattttgacttagccaatcctgttactaaagtcgatgatatccccgattatgaaatgtacagtcaaacaatcgatagcttaaataagcgttttggcaatcgtgttttaaaaggcatcgaaatcggttacatcgcttctgaaaaggatcggatcatcgactatttagccgataaagattacgatttaaaattactcagtgtgcatcataatggtcaatttgattatttagatgacgaagtcaaagatatggatcctgctattgtgattcctcagtattttgcacaactttcagaagcactagttgttatagaagcagatgtctttgctcattttgactatggttttcgggtatttggtctatccgttgctgaatttaaacaatatgaagcgcagtttttaccgattctagatcaagtaatcaaaaataaattggcattcgaattaaatgctaagagcgcttacttgtatgacaatttagcgttatatgaatatgtcatcgatttatatctttcacgtggtggtaccttgtttagtgttggatcagatgggcattaccttgaacatttccgtttccatttcgatgatctttttgctctgttaaaagcaaaagatgtgacggaattagcgatttatcaaaaaggaaagcgaattatggttccattaccagtctaaaaaaacgtcctcagcatcaaaagtgaggacgtttttttagatttctttttctaaaatcggacaaatacgatcttgttttcctaaaggaaaatgtttgatcccgatttttttaaatccatgacgttcataaaaacgaatacctgcatgatttttttcataaacagtcaaacgtaaataacgtttttgtttcgttttagcataacgattcgcttcatcgagtaaccgttgccctaaccctttgttttgataatctttgagcagatagagccgttgaatctctatagcatctttttcatcattgactttcatataaccaatgagtatttgatgatccttaataccaataaatttactggttgactgtgccaattctactgccaatatttcagttgtcaattgtgtctgtaaatatccttgcatatcaagtggatctgcgccatcgataaacgattcataaaaactgacaacacttacaacttgtaaagcatctagatcatcataatctaaatacgctagtgtgatttgattgttcatctaactcctccttttgacatagtatactataaatcacccgtggtgctagttaattttaatatcctaaagaatatctcaaagttccttcaaaacgtcgttgtgctcgacttaatagaacactgtaagccagtaatatgctttcaaatctactctctagccctttaacagaacgtgagttgaaattttgacaacctaatttttctaaggaagaaaaaacagtctcaactgtttttctttgttttccaagtaagctgtggtctagtttttcagatttatccatgtttttacgtggcggaacggatatagtaatgcccttaagggcaagcttttcatggattttatggctaatatatcctttgtcccctaggatattgggaagattcgcttcttccgataaagtctctaacactttcacgtcatggacacctggattcgtgatttagtaagtaatcggaaagccagtcttagtaacgatcatatgaattttaagaccataaaaataagatttttttgttgagttatagccaactttggctatttgattcaatagttttgcttgtctatttctaactggtttacataataaactaggaaaactatctataattccgactagttcacctttggtgagcttcttgatgaaaaagtatcgaataatcttgatagtgtaagctaagtttgaacttaagcgagtgaatcgactcctactaggaaagtcaccattaggaaataagacggaacaaaccgctctatacgtagctctttggttagtatagccattaattatgccccatataacacaagcaataatcactgtatcgcgttgcttcagttgatcagtatttcttcggtttttaatcttatctggtacacaattgtggtatatgttagaaacagttctcataatttccttgaatgttataaaagtatctgtataatgttcagtatattttgatgaacgcatatgtagtcctcatttcttgggagttttgagactactatatgcgtttttttgttgatttaccaacatgtttagacattttcctctaggaaaaaattaactagcaccacgggtttaataagttttgtaataattactcgacacggtagttcgttagctacgcagccactgatcgttgcatagtttctgacattgttcttatgattcagtaactcttattccgtttgactcctaatagttcatgggcgaagcgcgtccgtctaaaatagttgtttctatcgtttgaacctcattgacaatttttggagaatcttaccattccttttcagcagttaaatgtaaaattctttaatagctacgcttatttttcatccagaatgataacctcccaaatttttccttctatctatatagcatcattttgtgtttcacgtaattgaactagttgagcaaaatcaattaaagattcaatcgacaatccagcatttcgcaagttttttgctagataaatccaatttaaatcattggtagtataatctcggtagccgctctcgtggcggtgaacgggtggtatcacgccaacacgctcataatagcttagtgtatccacacttaaatcaaacatttcagctgcttttttatattcatcgaatctcctcctcattcttcttatttataataaaccatggagttaactctagagaaaccagaagcctcttgtctctatgctaatactatactaaatacctcctcacattccgtagactattaaaatattaagcaatagataaaatcagttaaatgcaacttctcatattctaatgtttattaagtaagaataatgttaaaataaaaaaacgaagagtattcggcgcagtccagaaaaacttccccaagttttctgtgccggtactcttcttagattaatgcatgttgcttaatcagcctacgctatatatttcttttttgcaagtaattacgatgtagaagcaatgcttaggaatcccttacgttttttctatttttacttttgacttcttttaagtgctatactggataagtaccatgaaagtaggtgttcaaatatgaatactaatttttatccagtggaagtttttagttcggactaccgtttatattcatcaaaagcaaaaacaaatttgtatgattttcaatcgagaccacctttgatcacgtcatttgctgtgctaaatttgaaagagttgcacaatattcaactcaaattatttatttacgatattgatatcgaaaaattttctactttagaggaagctaagggagtgtcaataattttgtgtaaatgattcttccctactgtagattgtttctaattctccatcggttgactcagcatttgttcgagctcgccttcggcctgttggaaacctttatgactgcgacctaggaatttttggttgtgagtatcaaaagacgagactaagaaacgttccatcgactcttcattttggaactgttccttgcggtggctgtatttcttgatttgcttattaaaggattcaattaatccagttgctgcactatataaaaaatttcatcatagtttcgccctagtcgttccaaagattcgatgacaaaaatatctttcttccttaaaaaatgaagttctttttgtaattattctcgtgaggtcttcttttaactacataaaattgtaaccactggttttaagagtagtgtatcatcccaaatcatataattaattgactgcgattgttataaaactcacggtaagccatataactagcaataaacgaagaaatcgcagtaactgaaatcaacataaacatcacaacaatttggtaacgaatcgcttgaacaggatcaattcccgcaaaaatcaaccctgacatcatacctggtaggctgacaagtccaaccgtttttgttcggtcaatagaaggagccatgcccgttttgacgctttctcttacaatactcatggacgcttgttttttattggctcccaatgccaatttttccaatacctgttggcgttggtccgtaaattttgaattcaaagaccgataggtcactccaatcgcagtcatggcgttgctggcaatcatgcctgtaattggaactatttgggaaggggaccagtcaatgactcctgaaaaaacaagaatgagtaaggacaaggctgttcctactccaatagccgtcgttgaaattttaaaagagcggttgatcccctcactgcgtgtatgggcgttataagaagcgttgaacacaatgaacaaaaccatcgctaaagtgagaaagttgttatccactcgtaatacgtagctcaatacatatccaataaggaataattgaacgacagcgcgaattcccgcaataaaaatgtcgtttcctaatcccaatttctctttgtaatcaatcaacaaggcaactatcaagaggacagaggataaaagcaaagaaagattactgatttccaaattgtttgtcatttcgattcctccatttttccacctttgatagtaatcagacgagaagcttggtcgatttcttcctggttgtgagtgacggccaacaccgtagtttgttggtctttcatcatgtctcggactaaatcaaggacaatcgctctgttttcttggtccaatgaactggtaacttcatccaggagcaacactttcggttgatacatcaaatttcggaccaatgcaacccgttgtttttcccctcctgatagttccttgacctctttcgataagtaagtttcaggtatttgaactcgttctaataatttttttgcacgttcccgatcaaatccttcttctcttatgcgggcaggaaaagacaagttctcttgaactgtctcatcgaatagagaagcgttttgaaagaaataagagacttcttttctatactccacaggatcgattttttgcagatccgtacctcgataataaatttttccggaagttggagaaagcagcgtaccaattaatttcaaaagggtactttttccacttccagaaggaccagaaaaaacaatcacttcccctttgtttactgtaaaagagatatcttgaaggatttggtttccgtttgcctgaaaaccaaccttctctaattgaaacaatgaatcactcataccacttctctcctttataaaaaagccctgcaccagtggaccatccatacgggtgctgggcttttgtttcatcctagtgtacctcagtgttcgtttggatcgtttttggcgtcttcatgagtagggtgaaccgttccttcaaggtgatctggaccagcataaatggtatacagtctgagcggcttatcaccggtgttttcgatgttgtgccacatgtccgccggaacaaatacggcgtcatcatccatcactttttgttgaacatgtaagttatctttagaaggccccattttacacacgccttctccttcttcaatacggataaattggtcaatgccttcgtgcacttccaaaccgatgtcatcgcccggttgaatggacattacggtgacttgcagtttactgcctgtccaaatggtcgtccggtaattatcatttcctgtggtggcgtcttcaatattaatgatatacggcttcttcccatgatccttgtagtctatttccatcttccattcctcctagtctttgtactgaaacaatgatacctacttcttatttataataattctaattaatggtaccacatctaaaattctatgcaaaaaaattggctttttggagagcgattctaaacaaagaccatataacgcgcaattacaattggtaccccttaatcctcagcacataaaggaaaaaatatggaatcaaaaaataaccgatatgtactctggttatgacttgaatcagggagaatttcagagacgacacatcatactttttagtttacacttgtaaactaactagcgtacactaagcttatgctcactatcaagcgttgtcaatcctttagactcttatcaatttcgaaagaaagtagcaaggttattgattgtgactgtaaaagtggggtgttcctataagcacattaaactatcttctctaatttatcatgctatttaaattctgttttttcatgagaatttttgtccaaaacttgttaaaatgattttaaaaaatacttacatacacaatccccaaaagacactaatgtcatttcagtcaaaaaagataccgcagaaaatttccacctgagattcaatacgatattactctcttgacagccagcttaattccttagttgaatagattattaaagtgcacaaaaaaacaatgcggcgtttgttatattttctggtataagcgacggtgctataaacttttttgcagattaaaaatcatatgaatttaactccagtaataagagattaagtgccaatgcataaatggaggcatgtccagcactatgcgaatgctaaaacatcaatagtacaggaaatcatgaaaagagcgaatagtaataatgcttaaggagagtgtcatgttttcttggtttgttataggaggttatatcaatgaaaaatacagtagataatttgtcgaaaagtaaagttattttaatgtgcggccctgcgggagcaggtaaatcaacactagcaaaaaaatttgaaagtaccgggatgacaatactatcttatgatgaagaatcattcaaacgaggtttgaatgaacatcctttacctcaggaggttttagaagatattaaaacctatcttgatgaaaaactaatttcacttatcatgcaaaacattgatattgttctcgattattcattttggtctagagaaatgagaaatgaatatatttcattattaaagaaatacgacatagaacccaaaatctattatataaagacacctaaggaagttgttatggaacgtattcgaaaaagaaacggaaatcatcaaaatgatatcatattgacggagcaaacagcttccacttattatgatcattttcaacccccaactgatgaagaaggtgaagttatagtagtcgagggatattaatattgtggttttaggcatggaaattgtactagatgataagttttgtcaaattttttgaaagatatacttccaacaaggggataccagcttcaggtgatatcattattgtcatctcagagcagggggtagtattgattcagccggaagaataagtggcgatgcaatgaagacgatgaatgcattattgaaattacaggaaaaaaacttactgaaatacgttatgtttattcttttgacaactctactcaatcatgattatgcaattagacacgttattttttatcatgaatggatatgttcccgtctaccgatagtgctaaaaacgcagtggatatgtttccgagaacgaacatactcaaatgacattcattctgtcctctcaagccacatcgagttggtgggattgataacaagggtggataagtagaggctggaaatggcttgatatagcggtattttgaggattttggagagttgagattatttcttcttccatttctaaatccaatgttacttgttctgattctggttctgttggctcatttgggattaaatccactactagcgttgagttagttaactttgcaatttgttctagtgtttttatggttggatctgattttcctgattctattcgtgaataatttgatctactcatttctaattcttgggagaatttttcttttgatttggtacctctcatcttttttaagttttctctaatgctagttccaagtttctccccctgtttatgtaaatattttgcacgttttccatttaattatatcgttacaccttgtaaatcacaagtgattaatcacaaatcacttgtgattagtgattttagcttttatcttaatttatcaactgtttagaatattaagtatgctatactaattaacggcaacttgccccgtaagggggtgctattcatggaacaaattatctcgttagttatcgcaccacttttagtgggtctaataatcacattagtggatcattggttagatgattagacgatagcaagcaagttgctgtctaactcacacgcttgtattcgcaacaagtgcaaagaaaagcccgacctactcgcaataggttgggcttttgtgctattcattagaacttatctcgtttcgcacattcattatagcatgattttaaaatgaagccaagttgctgattctatctgttgttattggtgttgcctagaacgattctaagcacatgtttaattttaaagtgggcaattttatctttaaaatgtcctacaatgattcaataaaagcatggctgctagtgaaacttgcgaccatgcttttaaatttacttaaattctctttttaaaaatgattcctgatcctaataccattaatgaacctaggacagacaatgcaatatttgctgtttcacctgtttttggtaaaactttcatttttccgtctaaacctttaactgtaactgttccgtctttttgaacgtctgctccaatttctttagcttcaactttttttgttgttcctatattcaaaaatcatttgacgattaattattttttaggtagcgtatgtttcaataaaccaattgagtctatcgttaataagctaaataatcagcctatagaatagcaagaatggaaaaactaacatgaaaaattttacgaagagtcaatttttttgactcatctaaaataatttacatattatctccaccaaaaaacatagctattaccggcataacgataaggaagattggaattaagcaaattcctgtaagccaaaacttctttgattttttataaattccataaataattatggctaagggtataaaccaaactgcaaaaaaataaattgtgtatgagagcataagtctcttcctccttttaaacaaaggtatcatgacaaaaaatttaactctataagaatttcaattctttaaacctttttaataaaaaatagtgtttaaaaaaatacttattagatactttatctcatttttataatttttacaaacactcttaatattgaatttaattagacaattctagtagaaaagtatctttcatgcagcactattcaaacaattttcgcaacttctttttttatcttcatttcttcattgtgtaaagggccacgataaaatgtaggaaaagggccatcgaaaatgtaggttagatttaaaatctgatattctttttcatgaaaccattcaaggagagtgactcatgcgaaaagatgtcttagaaggagtcttacgacacattatgaacgatattcaacctaactatgcagccatggccaagcaatataattgtgattaccgaacagtcaagcgttactatgaagctggaactaaatgggaagtagaacagatcaaaaagagacaatcttctgctcctcttttattaagcggttttgaagaaattattaaagataaaatggagttaagctgttccgcttcttcaatttattattttattaagaaaaaaggatatcaaggtggctataccaccgtcaaacgatattgtcggaactatcgagaaaagcgtgtaaaaaaagcaaccattcgaattgaaacgacgccaggtctttctgctcaagtcgattggaaagaaaatattaagatggtgagtaaacatggtgaagtcttttacttcaatctttttctatatattctaggctattctcgcatgaaaaacttagaggtaacctttgatcgaacccaagcgaatgtcttcaattgtttggtcaatgcgtttgagtactgcgggaatggtgttcctcaagaaatttggtttgacaatatgaaaacagttgttgatagaagtaaaagccaatttagtcaaaccgtttttaccgaaaatttcgtcaatttgctaaagatgctggattcaatccgattgcttgtcgcccttttcgtccacaaaccaaaggcaaagttgaagctttagctcgtactgttaaccgcttaatggtctttaactacgagtttgaaaatgagcaggagctaaaacgaatcgtctatgagtttatgaatgacttaaataatgaacgttctcaagcagtgaataatcatccctctaagcttcttatagatgaacaatcggtgttgcgtcctttcaatcgtttagaattagtcagatatgtttctagaacccaacacgtaattagaaaagtttccattgaatccatggtccaatatcaaaactcaaagtattctgttcccgtgaaatatattggtaaagaggtaactttagatgtccgtaaggacagtctattcatttggtatggccatcaatgtattcgctcgcacccattaagcaaaaaaaccttaaattatcaacgtgatgactctcttgagattcttcgatctgatgtcttcaaatacttagaagacgaagagttggagcgctttgtagaagaaaatttagatgcttacgatgaattataaggaggctcatatgtcaaattaccatcagttattaaatcaattatcagatttaaatcttacctgtatcaaagaaattttacctgcccatttagatgaagtagctaaaaatgaacaatctctagttgattctttatttgaattaacacatcaagaaattagctatcgtagaaaggagacccaaagaaaaattttaaaacgggcaatgtttccctatcataaacgccttcatgatttttaactttgattttcaacccaaaatcaaaaaaagtgaaattcaagatttagtgacattacgctttttagacacgtatgacaaccttttattcattggaaatagcggtgttggaaaaacccatttagccgtttcaattggtttagagtgtattgatagagggcagagctgtttatttatcactagtacagaactggttaatcgacttatccgggcacataaacgtgggacaagtgataccatgctcaaaaaatatgcgagctattctgtattaattattgatgaagtcgggtatctccccttctcaaaagaaggatctaacttactgtttcaactaattaatatgcgatacgaaagaaaatcaacgattattacaacgaatattcctctgtctcaatggtccgaaatttttggtaataagaaattgactaatgctttattggaccgattggtccatcattctaaaattattcaaattacaggaccttcctatcgaatgaaaagttatagtgaaacgaaaggaaaagaaacgaaacgataaagagaaaactacctacaatttcaatggcccaaaaccaacattttattatggcccttgacaactggcaaaccatacaacttttaaacaactggcaacaacgtcaaaaaaaggagctttctatactaggtttaagccatcagagtaataagcaactagtcttccccaatcgttcaaataacttttgtcgtcctagtcaaccaaatgattggtatgatatgatcgctaataaatataaacttgaaaaacggataactcttcatgaatttagaaaaactcacgtttccttgtgcgcaatggcagatatgaaactagaggatattatgtatcgtgttggacatagagattcaaaaatgacaaaacaagtctacaactatttttatccagaacgagaagaacgaagtgctgataaatttgctcaatttattgagcaagaaaaagatttgttttaatcattttcataaattttggatacaaaataggctagtatcactgaacaaagtaatactagcctatttgtctcatcaaatttctaccaactcaacgagaacaaactaccaaaatggtatgcttacctatttttcttttgatgcactaacttattgcttgtagtaaactagttaaaacaaaaaacatttcaaggagtgatttaatgtcccaattgaatcaaacatacgaaaattatttacaacaaccagaagcgttatcttttactgaaatgaccactatctatcaagaaatattgaaaaatgctgatatgaatgataatgattttatcgggatttgggaagagctgatgggtgctgctattcgttatacagtcattcgtgcagaatggcctcaattttctagggaacaaaaactggcaaaagattccgaacgaacgaatattcacaataccattatcgaccatttcatcctattggaacgcatctttcaattaaaccattgggacagtcattcttggacatcacgcttattcttacaagaagaacaagaacaacgtacaagaagtgatgtgaatgaccaccgacaacggattggcgatttcgcgaattatttggtgtttgtttcagcggttaatggacgatagatatgaaagtcacgatttgataaattctcatcatagtagattatcaatatttttttctaacgtctactatgatgggagcatatcatttgattatcagttcttatacattttctttaatagctttttacgtctgttttttatttgttccatcattaaattctccgtcagaggagatatttgatcaaatttcttttgacatcttctagcataggaaatgaagtttccaaatttactccctttactatcccttacacccacatcaaaaaaatatctataaatatgccttttaccaattagataactcgagttctcaaattcccctacaccaactaagcttggctcacctagggctttgcttgcaaatgtaagttcaacaggtgtctcatctaacacatatcctctaggcgcttttgtctcaataaattgataatctcctggtgccagattttttaccaatacaacccccttatcatccgatacaagattttgtataaccgtttttccttctttatcgatgagcttgaattttgcgccaggcaatgggttttctttactatctgttttcaccaattgtgctgattcttgataattcacaaaaccttcacttgcaatacctacttcaggttgtccctctgttgagtcatttatagtgaaatctttaaccgatagataattggctacttttgactagtgccatgattgacatggtattggaaagatattcaacatatactaacaaaaacagaaaacgattatttaactgaatttctgattacaatttcatgttttacaatcttagattctacgtttccgcctttttcaacaagttgaatcaacatgtcaattgcctcactccccatttcatgaaaaggttgagatactgttgttaaagctggtgtactcattcttgctgttaatgaattatcatagccgatcactgacaattcctcaggaattttaatcccagcttcagaacaagctgacatgacacccaatgctgtttcatcactggcactaacaattccatcatagcaaacacccgattgaataatttcctccatattcttctttccagaatcaaaaccataatctccaaaataaatatctgtatcagaataaatcaattgatgatggatcaacgtttttttaaatccttttatccgtgccttccctgcgatacgatcagatggatttacaccaatcagagctagtttttgacttccacgcttgattaaatatgaagtagcatcggcaatcgcctgttcatcattgactttaacaaacggaatatcccccttcaccgtatctgcagaaagcaacacacaaggaatattgtgttttttaattaaatggatctcatcatttgataaatctacagaaaaaatgataaacccgtcaacatttctctccttcataagcgtgatgctttctttcatcctagacccatctacgcctgcatgtgtcaaaataacgttatagcctctttgataggcttcatcttcaatcccgctaataatatcaccataaaaagtagtagcatactgcggcataataatacctaacaaatttgactttctactcaccaatgatacagcagatttattctgactatagcccaactcatgagtaatagctaaaattttttgttttgtttcctcgctgtatccaccaagaccattaataactcgtgaaactgtagctatcgagacattcgctctcttggcaatgtctttaattgtatattgcatagaaacctcctgagtaaacgcttacgttgttagctctagtattacacaaatatgagggaaatgcgagaggttttagtataaaaaaagaacctcgcgccttcattagtgaaataaatgaagcacacgggttcacaataaattttcttgttcaacgtttgaacatgcgccttctgcgggttgatcttctgtcgttcatcctttttgcttaaagtaaagcatgtcccaatactctaacgagggaacagtgatcgtaacgaaatttccttgcgcatcatgtccatattccatatccagttctttagaaacggaattatatctcggatctggggaagtgagccaagcactttcaaatgtgtcattcgtataatatttcactgtcaaatcttcaacaatagtaggtgtttctttctctccttgatttgctcgccaatcattatcagaaacgccaagtaaattgatcatttgaatcgtatcgaatccactaccagacttactatatgcccagattgtattaggctgtccatcgctcgattgattttgatcgacaaattcaatctgatgcccattatcttctaatccatcccgcaaaagattttgataagcaacaataaaattttgcagcgctttttgacgtactttgtgttcatctgacatatataaattatgcttgggaaaatattcattcgatagcattgcgtcgccatcacctaattcaatacgtgaacctcctgcagcatatactgccgcatctgttaataaaactgcagacatattaaaaggttcactcaccacactctcagcataatcgtattccatatatgctggaatgatcagagatttcccatcactttggtctcgagaattatcgatgacgttctttagactttgataagtattgtactgctctccatcacttgttgtatcccaaggccagatttctgcatataggacatccacagcagaggcatttacctgttcgataccttgagcacctacaggattaaatgatagataatagctatcaagcttctctttggcaatatccaagaattctttatacccatccttcacataaataccttgtgtctcatcaccaatcatatcatgagtccacatttttccccattcacccactgtatctccatgccaaccatcaaatcccatcacttgtagagcttctaaatttttttgaataatatagttttgccattctggattttgaatatcaaagaaaaagagattggattgacctgtaggacttgcacccattgagaatgtaaatcgatcacctttatttttaccagcttcatgatcttctgcataccacagcccccactcttctttgataccatattgagcataattatttgtcgcagcataaatcatattataggacatatttgtcatccctcttgcttttgcttcagctatgtagcttttgatggtctctccactaatcttgcgaccagcccaatcttgccacttcattgttccatcttcaggaattaattgatgatgcaggtatttccaatcatagtattcaatcccatttaattgccagtcgttcatttgctcaatcactgcttcaatgtctatatccttatcgaaatttgtcaaaaagccatatctaggaaacttcgtccatgtgcttgacacatctgctgctgtattcatgtgtcgaatagcgtgaccctctgaatcgagtatgtccaattcaaataaatagcctttaaagtcttcgtttggtgcagtccattcaatttcctcttgaatgctcccttctgatgtcgtttcccaaacgccttcaatcgtatcgattgtttcgttcaagtatttcacgttgacaagatacttgcctttagatgtttctagagaatttgaacttgtcgataacgccaagatgatggtttccccgggatcatacatagatttatctactgaaaactttaatgttgcatcatattgaatgcccaccatctcctcttgcaattttttgttcatataagcactaccaaaaataaaaacgaaaagaaaggcaatgataataatcgaaacagtccagcttttttgtgtatctttttttgttgcaagaacttttctattatttttttctcttattttcgtcatatttactccttttctaaatatttcagtcactaagtaaatcagcttatttctaagacaacagcttcataggggtccaaatagagcataccttttgtatattctttcttcgtataattctgaatcaaaactgattttggctcttcctttagatcaaaagtagttgtcttttcttgaaaattagtaatgatcaaccatttttgctcatctagcacacggcaataagcaaaaatattttcgtcttcggtatcaaccaaattataagttccccaaactacaattggatgttcatgtcgcaattggattaattttttatatgtgtagaaaagggaatctttttcctcaagagctttctccacattgatttcaggataattaggatttatatgtagccaaggtttattcgaggtaaatcctgcattttttgaatcattccactgcatcggtgtccttgcgttatctctcccttttgcattgatcgagtccaaaatatcctcttttgcatagccctgcgacaagcggacattgtacatattgatactctcaatgtcatcgacttcttcaatggtttcaaccggataattgatcataccgatttcttctccctgataaatatacggggttccctttaataaatgcagcaaaattgcaaacatttttccactttggacgcgaaactctttatcattcccccagcgagaaatgattcttggtaaatcatggttattccaaaataaactattccatccctcggaagccagctctgtttgccacttggaaaaaacgtcctttagtgctggaatagacaggtcgattaaatcccacttttcttttcctggttgctgatcaagaccggaatgctcaaattggaaaaccattgacagttcattacgattgggtttggaatataatttagcaatttctggtgttgctccccaagtctctccaaccgtcataagatctttgttgccaaatgtagctcgattcatttcttgcaagtattcatgcagtttaggcccattccctgttatctttttgaatggttgtttaccaactaaatcaataacgtccattcggaatccgccaatccctttttcaatccaaaaattcatcatgtcataaacagactgtcttacttcttgattctcccagtttaaatccggctgttttttactgaataagtgtaaataatactgtcccgttaattcactatattcccaagctggaccagaaaatgttgaacctaaatcattgggcggattcccttgtgaatcaggatctgaccaaatgtaaaaatctctatattgattgtctcttgactgtctcgcctcaacaaaccagggatgttcatcactggtatgattaacaaccaagtccataacgattcggatattccgcttcatagcttctgcaatcagaatttccatgtcttccattgttccgaattcgtccattatctcttgataatctgaaatgtcataaccattatcatcatttggcgatttatagacaggacttaaccatatcgcatcaatgcctaaatacgccaagtaatccaatcgttggataatcccttttaaatcacctatgccatccccgttactatcttgaaaactacgaggatacacctgatatacgactgctttttgccaccatgaactcatattgaatctccttttacatttcatactttttaaatacacttaacattaaaaatgattttaagaatacaagaaaactacacccaataaaaatgctcagatacaacacaaaaacaaatgcaattggggaggtcactatcaaaaatagcaagaacaatgtgataactgataacaaaaagctcacccgcatatttgctaagacaagcctcatagagttcatgaaaacaagcttagccgaatctttaaagcgtgcaatataaccatacgtatattgactacttaacacaaggacaagacccacgatagataccccaagcaagccaatgagattttgctgatccaaatggatcatataattcaaatcgacaaccacaacgaaaaaaacaatagattgcatgatactaaaaccaatagcttgtttgaaatttcgtttatatgccaaaataaagttttcaataacacgtgtatcattgttttcatgcaacttaaagcaaacggcataagctgcgctggttgcaacaccaattgttacaattgggatactccctattaaaatacataaattgagaacgaacagactccacaacttcatcaaaaggttatagacgggtccatctattcgaaaaaaagaattcataggtttacttcccttcttcttaggttcttatcgaatccattgacttgtttttcaattatctcatgattagaattattcttttacagccccaacaacaattccctgtacaaaatatttctgtaaaaaaggataaatcactaacaaggggacaatcgctacaatgattttcgctgcattcagattacgatctgaaacagctaataaactttgtaattgttctgatgtcatgccgcttgcattttgcaaagtttctgcaatattgacagacagagattgaatgtacgtcattaatgggtaattttcaatttttgtcatataaatcaaaccaccaaagaaatcattccagctcccgacaatactaaataatgatacagttgccaaagaaggtaaagatatgggaatgtatatcttacgcagaacatcaaatgcatttgctccgtctaataatgcagactcttccaaagatttaggtacccctcgaaaaaaattcatgactaaaatgacactgccaataggcacagcacccggtaatattaacgcccagatactattgatcattcccagattacgcacaatcaagtaggtcggtatcatcccgccattaaagagcatcgcaaaaaccataaatcccataaagaaacgtctagtccgaaacactttttttgattttgataatgggtaagctaaggtgacgatcatcactaaattaaggaccaaagcaacaaatacacgaaaaacagagatcccaaacgaacgccaaaactgcgtatcgttaatgattctttcatatgctgcccacgtgagatctactggccaaagtcctactttattccctgcagctgcttgggaggaacttagggacagcgccagaacgtttaataaagggaccaaacaagatagtgttaataaaataacgattaaataaatcacaaattgtcgaataccgaatttctctctcatttttttctcctctctatgaattaaaacataacccgatttgtggctttttcagctgttttattcgagacataaatcaaaatcaaaccgataatcgaccggacaagtcctactgcagcccctaaactataatcacgtccgattaacccaattctataaatgtaagtatccaaaacatctccactagcatagactggtggtgaatataagttgtaaacttgatcaaatccggcacttaagatacctggtaaagccaagatggtcatcaaaataataaaagacatcatgcctggaatcgtcacatgttttacacgttgcaaccaactagcgccatccattgttgcagcctcatataaccctggatcaatcgatgtgattgccgctaagaaaataatagagttataaccaaatcctttccatacatctgtccaaatcaacaaatgtggaaacacagcattgctgcccaaaaagttaattcggtccaagcctaagctttgtaacacttgattcacagtaccatctaaattaaatagattgagaataactgatgccaagatgacccatgataagaagtgtggcaaataaacgattgtttgcatggttttcttcatccatttgacgcgaatctcattcaataaaatggcaaagataatcggaataatggtgttcaacacaattttccctactgcgataaaaaccgtattgtaggttacttgccagatatcaggcaaattaaaaatatagataaaattatctagtccaacaaaatccgaacccaaaaagccacgcgctggaacaaaatcttgaaatgccataattaaaccaaacattggcgcatacgagaagattagtagaaaaatcattcccggcgcaatcattgctagaaataaccactgatctttagaaaaccacttcttttttgttgcaagcttttccataaactttctccttatttgataattgataatatagtagagcatttgcagcaatgaacaaatgctctacccaaaatttagaaatgacctttattcatccgcgagcttttgcatttcttctaaaatcgcttgtccaccctgactattccaagtcttcacatatgaatcaaaattatccaaagattcttcccctgtcacaaatttgataaacgtctcttcttctaattttgaaatttgggcaccattccgctcacttgctttaatggtttcaaatgtcgtaaatggcgtgatttcattatagatattctcttcccgtacaccgttcatcacattagttacagccaataatctcgacgcatagaccgcccaatctgttggatctgcagtgctcgggtcatcaagataggttttaattttttgtgcattgttttttactgtgaaacttgaaatatcatcaatatctatctcaccttcagccgcttgagaagcttccactgcatcagatatttcacttaagttttcgaacatttcaatattcattggacgtactgatccgtctacagatttttgcgcataggcatatatttcaggatactctgtttccatatcggttgagtttggtacttcatcaaacaataaattgattatttttatggctaattctgggtttgcaaaatttttattaacaactacatagccacctacacctggtttgctcacaccatttacttgaccatcactactctcaattgcataaggcgtgaatgctgcatcagggtttgcagtttttgcttgaaccaaagcccaatcagataagtgccaagggccaggtataataccaagttctccattaatcatcatcgcattgatgtcgtcgtatgttcgcgtaccaaattgatcatctaaaattccatcgtcaaatagttgttttacgtagctcaatccttctttggttttggcagtatttgacccgtaaaccaactgaccatcttccccaactaaataatttttaggaaatgaatcaaaggcattgaatatcgcagttgctgtatacccagatcctccatgactatcggaagttagccaattggcaaatgcgagaccttgtgttttccctgttcctcctgcatctttgtctttgaacgttttggccgttgattctagctcttccaaagtaatggcatgattgccatcttcgtccaattggacatccaagtcatctaaccaatcttgtctaatccaaaccaaattaggaccaaaatcattcgcagtgcctggtagtcccataattcgatcgcctattttagcagaatcaatttggacattgtcaaaagaattgtaaatatttttgatattatcactagcgtattcttcataaacatctgttaaatcagcaatcaaatcattgtcagccaattcctccatctcatctctgctgacaaccattacatctggtagatcgcctgaagcaatggcaagcgacacttgtctggtataatcatcaccatttgcctcaaatgcactctcaatactcacacctagctcttcttttatcagtcttctataagcattatctgcataagagtctccatcagggagtttggagtttggctgcgtctgttgacccactgtcatgacaatatttccatcggtatctgtttttgcttctttgtcttgttcgccactgcatgctgcaagtaagacaacactactcaatacaactgaaccggtcaaaattttatgcatctttttcattcgtaatactccttttattcggtctacgtaatcgtttacataaataactaaaaaaaatgagaaaatactactaacaaaacaacgtaaacgtttactctataatagtatcattgtctatacgaacttgtcaatagcgctttcatttttttgtttattacagatatatatctatatcggtatcactagttaaaaatatagtgatttagagactccatcatctcctgtcaagggcagtttaaaattgtgggtttgggggtgcggatgtttttctggaccatttttaaaaatacatctttgtttcttccgatattgaagaggacttagtcctcctaaagttaacttgatccgtttatgattataccagtggatatagttatccaattggtttataaactgattgattgttgtgtttttccagtcacgttgataaaacacctcgttttttaatcgtccaaagaaaccttcatacactaagttatctggtgagcacccctttttagacatggagcgagtcaagtttgctttgttcattcgctcgatccaatctggtcatcgataatgagccccacgttcagaatgaatgattggacgctcttgaccttgaagggtagagctcagctcgtccacaatatagcatagtactcactaattctgcgtcaggatttgtttcaatggtccaactaataaaagctccatcgtagcaatcgacaagcgggaacaaatagattttccctttaggaattttaaactcagtaatatctattaactatttttcatttggtttttttgctttgaagttacgattcattagatttggttgtacaggagaaatcttctgagcatacgaatggttcgtgcgtaatattggccatattcaaaataataatccacggctattcgtttttgttcttcagaatactttgatttttccggtgattatgatgaagcttcccagataacaaatattcattataccattgacgtagtgcaccaacggacggatagcttaatttccaaatgatagcagcataagaacaatgatattttatattttcaatcttaaaaaaagtatcttatctttatttcccctatacattttcgttttcctctgaaaggttttcattacttagattatttttaccataacaatctaactatccatttctcattggtgttaattttgatgttactttctacacacccaaacaaaaaaagccagaaacgccttcaaataggcatttctagcttaaacaattctattaccccacagacccttccatatagattttcaaattacacactagtttaagataaaacaaacaaggaaaaacttaccatttactcaaaaaattaactcatataagtacattagaatgtaaaatagactggtcaaaatctggtcaaaaaagtagatgtgacacaagttcgcattcaaagcgatgatccatgatttcgtaatggtcaattatatggatcaaagccacgcgacaagagcgcaatggatgtctctaccgattggttgaataaacgaaataaatagaatgtgaaaaaggatcggacaaatgttcctgtttgctcgatccttttttatttgaattcattttcgctttatcaaacatcatttgattactcagttaaatacttttgacatgagtaccaatgaaacatttattcattaaaattacttatttcttatcgcctttctagccaatgccaatccgccgattattccagcactatcacctaattcgggcgtaacaatgtagctagcaattggtggtatttcaacatatccatttataagctcaacaaatttatcctgaacttttttcttcatgtgttcttgtttcattacaccaccgccaaaaataattctatctggcgaaagcatcagtgttgtattgtatgcacattgggcaaggtaaaaggcttcaatctgccaaaacgaatcgtcagccaataaattctggccttttacacccaaccgtttttcattcgctggtcctgctgccatcccctctaaacagtcttggtggaagggacagtttcctgaaaaaatgtcctttggatgtcgcttgatcaacatatgccccatttccggatgactgaacccttccacgaaagtcccattgaacaaggcaccacctccgatacctgttcccacagtgaagtatgcaacacctgctaaccctttgccagaaccagcaacatattcaccatagcaagccgcattaacatctgttgtccattcaatcggaatattgaaatgttgctttagcgttcctacaaaattgaaattctgccaagcaagtttcggtgttgatgtgatatgaccgtatttctttgatttacgttgaatatcaattggaccaaaacagccgaccccgattcctgccaattgttccttaaaaggtttaaaaaaatcaatgacctgcttcattgtttcaactggagtcgttgtgggaaaactgactctttccaaaatcgtcaattcctcagtactcactgcacaaataaatttagaccctccagcttcaattgccccatatatcatcataggcttctcccttcgaatatgtgtaaaacacttcattaacgcggcaagcgttctcgatcagtgaaatgacgtttagtatttcctgtggacgtcccaactcatcgtacttatgaaaggcccacgccccgccaaaataatcttctgaacctgttgaggttacggtcggatactcactatccccatcaatgtagaatttaaactcgccttcgccccaccaataacgttctaggcaggtaagcgcaaggtaagtacccacgtaatagccttgaccctttaatcgatcaattaacttataatcctcctgtaatttggtaatgcgttcccgatgccaaataatggttgaaggatttccctgccccattttttcagaagtcggtcctagacttattgattgtccaagaaactttctttacgtccacttcattcgggctttaacacaagcacacccaaccttctttgtagctgagaatgtaaagggcatgatgaccttagggaaaggagaagttttaaagcaaataatagaagattttacttctgccagttatacagttacaccacatcttgtaaatgcaagagattagggcgtaccacaattacgagaacgcgtatttctaattggtttcataaagaaaaaatcgaaaatagatttagttatcattacacggaacctgaaccatcccacggtgatatttcgtatataaatctttttaataataaaaaaccttatgtaactttgaaagacgctattgggatctagagtctgatccaggagacttttttgaaggagattactaaactatttatatgagtcgtaatagaaaaaatgtgggatgagcaatcattcaccatacaagcttctgggagacaagctccataacatccaagtggggaaatgatgacaaagttagagaaaaacaaatggagagttaacggagaaattaatcataggctttcggttaaagaaatagcacgcattcaaacttttactgattggtttcagttttctgctggaggaagtttaaaattaagtaaaatggtaggttggataaaatttacaaacaaataggaaatgctgttccagttcttttagcgaaagcaatgacataaccaattgctgattttgtgtccactaatgtattgggggaagtaatgagaactaatattattgatgctatgataaacatagttcattcaggagtttatagcctacaagaatcatatatcagagcaagccgggcaacttctatgggtgatgctttagataaatatgtgactgatagcttctgtggagccatcggggagtcagatgaatttgtgaggttaaaaaataaaagaggtattttcttacctagggaacgactcctgctccaccggatgcaatgttaagaggtggagcaggagtcgagataaagaagatacaatccagaggctcttcattacaattgaacagttcccatcataaatctaaattatatgcgactgatccattgattactagtcacgatcgagttatcttgcgattgccgattcgacaaaggacgcaccagttttttccaagcttcaattttctttcgtttctgataattaaggtttttgactttacgtaaaaatgtgatattctcggttttcgtcattgtaaattcatgctttattgattgtgcaggaacttcaataattcatgaaattggtcaatgacgtgtttttattttgtgaagtggctaagttcattataaaatccgccattcttttattttcgtattttaacttcggatatctttcttttcatttcctattctatccacgcagtgactgggaaatgatcagaaggatagcgaccattgatacaatcagtgacaatttccgttctaagaagtctcatcgccggatttatccaaatgtaatcgattcttgacatcgttgaccaattgatatcattacaaaatttattagtacctgtgcaggttacaaaagggccaatatgatagggtgagttaatcagcgtatcttttaaagtctgtgaaaactgtttataaaaagcttctcttggttctccatttaaatcaccaacaatcgctgcatttttttcttttctttctttcaaaaaattagcgattaaagcggctcctttttctctagcaaattcacttgcaaaatctaaatgagtcgcaatgaaaagaatttctttatcgctatttttttctctcagaactgcccacgtagcaatccgtggacaagcagcattccaagagtaggcatgcgaccttttttcgggagtatctgacagccaaaaagtgccattgtctaagcaaaaaaacttatcttctctataaaacacgggattatactctccttcatcagaatcgtcacgtatttctccaacaaaactatacttatctaattccttcaattcttttaattgatcttcttttacttcttgaagtccaaaaacatcccaattttgtctttgaattattttcttaatagattcttttcgattctcccaactgtctaatgggtcttcgtataaaggtccactatttttaatattaaacgttcctagtctaaacatacttattctctcctataaaaatatttttaacttttttaattataacgattattgaagattatgatcttttgacttattctcttcgatttttaaatacatttttttatataaatcattgagcttatcatttggaaaaagtaccaacattttagcgcgagccatgtagtgaccccaaaagttggacttttatggagtggagaaatccactccttttttgtacgataaaatttgctgttagacagctgtttttacagcttctcgaaactgaaccggacttcgccaatttaatttcgttatgatgcgtttatggttataataatagatatattggtcaatttttgttttcaattcatctacactctgatagacttctccatgaaaaatctcttgctttaataaaccaaagaagttttccataggtgagttatctaaacaattccctttacgagacatactatggaagattttatgctgcttcaatttattcgtataagcattcatttgataggcccatccttgatctgaatggaaggttctacgaaatgagcaatcatttgtcatctggattgcttcttctaatccttccattatggctagtgcgtatggtttttcagaaatctgataagatagaatttcactattgtagagatccctgaaaggatctaaatacagctttttctgacgaacgatacctgtggtgtctaattcataatacttaaactctgtggtatcagttataattttttggtgacagatatttgtataaaaccgacgatgcatacgatttttggcgacagtaccaaccttcccacgataagaattgtaccgtcgagattttcgagtgtaagactctacttcgatacctagtttttttatcagacgttgaatcttctttttattgatatgaatcccttgattctctaattctttttttagtcgcagacagccatagtctttatgctctttgcgaatttcaagtattttttcttcaatttcttggtctgggtttagtctgtcaaatcgtttctgccaatacatataggttgctttaggaaacttcaatgtttcagaagctcaactagtttgaatgatccccggaggctggcgatgattcgtacgattgattcttgcggctttgctgggcttcctgttttcgcatcttcctcaactcttttaaaaaggcattctcaatttgaagggatcggacttgcttttctaatgccttgatacgatcgcgttcttcagttgttgtattttcttttttgttttcttttttctagtcaaagtaagaggtcgccctttcttttttgagagcctctcaatacctgcttctctgaaattacgtatccaattggtaataagcgcggggttgttcatatctaaagtgctgtcaacttctcgataggacatctcacttgtttgatataactctatcgcatttaacttaaattgaacagaatatttctgattttgacgttttctcaatagacctttctctccgtattcacgataggcattcacccaatcacttacttaagacttgcttgaaataccgtatttgttggcaagatgccgatatcctcccacgccactaagatattctttaacgatttttagttttaattcaaaatgatattttgccatacagatagcgacccccatcgcatcaggggattgtttctcatatttcatcagtgatctgcatagaccagaactttgggacaaagatccacttgagctacttaatggaatttaagagagccttgtcatactcgctctgtccagtgtcggaggaatagacatagtattatacttataacctttgtcattatgcttttgtcttcaaatccggcgaatggtgctattcttaatttctgtgtgaatagtttggcgagcacgatcaaatttctcagcaatctagctcccaaacatcgcttgtccaacgaacgaagtatttcaatttgtacacgttccttataagtaaggtgatttcctttaagtgattctgtggtattctaagtttacgtcatcgtgatttcatccttatggtagtgtcggaacttcaataatacatgaaatttttcgatggcatttttttattttatgaaacggataagttcattataaaattcacctgttttctttaattgaaataatatcgctaattgtgatttagactattactttgaattttatctaaccatatttacatattgaccacttttttacgattatttaagacactgcgatgcgcataaacttctctttcggtattttcaatgactaagccaattattatttcgttaatattaggagatagttcaataattaagtaaactttctcattcactggaacgtcaattgaatgactgttggccgccaccgtcgccactgtatagttactatccaagaaggtttttttagccgaattgatcgatagccagtactgctgacaatctttacactatcattgcctttccaatacatagtaggggtggtacctacaccattattacctccacctttaagaaactgactaccaatatagttactgtcaaagtttcgctatttagagactcactataaatgcacagttcgatgatatcgacctacttcgcttcatcggtaatcatattcatttgctgattgaataagacttcactgatagaggatcaagtatcacattagacactttcgtttatcaaatggtacgactctttaaagccttcattttctcgaaacggtccaataccatcggtgatatacatcttcttggtaatatgcagatacccgatctgctttgttccagatcatctctcgacctaaaatagtcaaataatgattgactttttccactacatctaggaaagttcacttgaaaataagccactctttatcaatgagataaccgtcacaatacattttgtgatattccatgtctatccatttgttttcagttcctactagtttataataagtatctagataaccatcttcttgagcagatgcgatataactaataatttcgtcaatctctgtgtccaaatcaggatcctgttctaattgtaagaaatacgtagcaccttataacattttatagacatcggactcgtcgaaataaatcccgataaattctccaagtatcaggctcctcttttttgaaattgtctatgcgaccactttcataacacttatctaaacaggtacggattaaaaattttttctattggttcagcttcggagtctaaaaattgttattgatggtaatttgattgaagttgatttgatttgtcatttggatcctcctatgaaaaaatgactttatgaaacacggaataagccacttttaaccagtggcctatttcgtgataaattatctattttggtgtcatgctaaatggtcgtttttggttgaagcatttaggatttggtaccataccaagttcaaaattaagattcatccctgccactaaatcatcatgagaaaaaaaggatttgtgatacacttggccagattcagtcactcgatgaataaattgttgttgcgggttattcatttcggtagtcagattaagatccttgccattagataaatggagtacggctttgtcgaaattgggcataccaatcaagtactcgtcatgtcctgggcaaaaaggatagaaccctagagagttgaaaatataccaagtagccatgctaccattatcttcatccccgggatagccttgccagccatcgctaaacaaacagttgatagcttgtttcaataaaggctgggcataataaggcttaccgatataactgtatagataaggtagatggaagctaggttgattccctacgttgatttgaccaaatccattgtactcactttcggccatttcatggattagatgaccataaccttcaacagtaaaagctggtttggaattgcccaagcgcaccaaaatatcttcaaatccctcatcactaccataaaggttgattaagccctggatatcttggacaacggcaaaattggattgccaagcacaaccttctgtgtaatcaccaccccaagaaattgggctaaagttttcgttaaatttaccttcacgatctttagccaccataaatccttcttctttcgaaaagaggttgcgatagttcatggattgatctgcatatttttgggcaagttccacctcgcctaatttatatgccaccaccgaaatacaataatcgctatagcagtaatctaacgtatgattgacagattcatgcatatcttgtggtacataaccatattccaaatattccgcacaataagagcggccaaataagcgtttttcatcttgtaccatcgccgaatgaagcattccttccaaaaattccggcatcaaatccatccgaatctctttggctgcagcatcagcaatcacagcgtcgatataattgcctggcatccctccagaatcttctggagataaccatttaggtaagaatccactttctttatagttatttaaaaatccttccaaaatcttcgaatattcttccgtttcaatcaaagaatataaaggataaaccgtccgagccgtatcccaaaagccattgttcatatagagatatcctggttttacattatcttcataaacatctcggtgaacgggttcacctttttcatcaaactcatataaccgctgagggtacaaaaacgcccggtacaaattgtgataaaaggtgctaactttatctttgtccaagtcggttacttcgatcttggctaatttctcattccatagattagtggcggttacttgtagtttagcccctggttccataggggtgtttttcacagcatatgttgtggaaataaaagaagtacctactcggagctccaccgttgatgtatcttgaaagtcgatttcgtaggtatcatcatcttttttagtcaaatttgctacaccagtttccacctcgatgtggaagtacagctttagcgggacctttccgtgagtatgcaactggttagaccaaccttcaattaccctatcttcagctttagtaattgtacccgaagttggaaaactcactagcatacctttttgatcttggggagatgtcatagtaattaaagccccgtattctgttggtacaacacttgtttccaactgattattcggctgactaatctttagataatgaggatggaattctgaccgctcaggactataagagactgttttcaagcctttggtaggacgagtatatggcaacaaacgaattgaacaaaaatctccttttgttcctgcccacatagtaggctgatgggacaaacgaaggcctctaaaatgtttagcttcaggatgaaaccaccaattatcttcgtgggtttcaacagcaaaaaaattcattccaaatggcaaagtggtaaaaggaaagcaattacctcgtgatagttcaaatgaattgctcgttgcgtgacgcgtgtcgatttggttgatgttcattgataaaaactcccttaataaatttttattttttattttttaaattactcgttgcaatataattctgtttaaacttgtctttcattaattcaacgcacttcatccaaattaacttttgctttatggtctggtgtcaataatccattaacctcttgttacacatccgtcaactgcaagtaacaatagcccgtaatgtaagagattacttgaatggctttgtgagttttttcaaatccatttataaattcaacttccattttcaccctagcttgagaagtgtaagtaccccgatgattttccatgtaaagatcttggaacggcttcttcactatcttcgattcgttcgtacagtttttaaaggtaattatccactcacgttggttgaaccgtggacatccatgggagttcattgatgattttacatcctctaccatttctctagttggaccgccatcaccattactgaagaagaccaataaatcagcgtttagcggtttgtcttggtagatgtagtaagctcgacatcaatgaatgtaggtaattgtacccattataagtcgccctacagccttcatccgaccggagatcatagttttcattcaccgtcgtaatgaaatagaccaagaattcacttctatcaatttattgacaattaaagttatcctgaggcatgtcgctggtttcattccagctaattttagtggtcctaaaattcttgataccaaagttttacataatttgtggcaaggatgttgtatacccaaagacatctggcaaccatagtactgttttttggcattaaagtgttttcctaagcaatccaatcaatacaagaattgtcgcgtcaaaatttccgcaatgtctgttttcatccaatccacaccatccacatcccagcgaccttcttgaatatgctgtttgatttgttaaaaaaatttagagcggtcttctttaatatattgataaacttgaggtgtactgtgcataaagatatagtctggatagtcttttagtaagcttagctcggtagaaaaggaacgagaagttttttccacgtatgagctaagccccataatcaagtcacatcattatggttacttcccacaacagaaacggtaaatagtttcttttctctttcatgctctttaatagaggcctgaatcatggccattgcttcttttgtctttccagcaaagatggttggagtcatcattgccaaattgaggtaattgactatttacttaatgaattttaaataggattatttgatagactaatctttggcacgcttagcaacagcttgatccatcgcatccaggtaacggatacattcatagacggtactgtaaaatttaccaccatgaataccccagtaggtaaaagtagttacgggttataaagtagtattgtggcttaggccggtccaaaaacaactgacatcttgacgtttttttcggaatagctgtaatctaatatgatatccgatggttagaatttacgctttactcggcgtgacatcagcaaaactatcgccattgtgaaaagaataccatttaacgtcttctgacaaagggttgtgcattccctgtaaatcatgcgtgctttcaattgcaaaacccgttttcagctgctcaaagcaagagtcttggatcaatcaaaactgtttgcgaagctttggtaaagtatactgccttcttcctagaaagtttatgtgtaaaaagcgattggtcagaccattagtaaaataccaaatagcattccatctgttaacatttttttgaacacatgtttactaccaatagcgaataaacacaactgctattagtttaattgaaccaaaatttctccaccggttccaacgtattgaatcactagcaactctgtttcttcagaactaattaattgtaaaggtagaatctgtccagtgtcatcctatatgacagactgggccccagtcgtcacataattcaatgcgatataagaggttaccttttaaccaggtctcccccggtttaattaagagtctccgtgacatatttaaattcaggggtactcaaatcaacaaaatatctttaaaccaatgaacatcctctttgcaagctaagtgtgttagtttggtactactcttatccgttaggtgctattacagctgataaccaagtacgatacacttcttctaatataggtgaatcacaatttgctgcaggctttccttaaagacactaacaccgctcttaaccaccgagatttgtaggtgtttttaattatcttcaatacctggcaattgttacaaatggaactaagacgtctgctgattgcgtaccccatcattccaccaagcggctatttgattgtaaggatcactttcattgcatacatatagtagggttccaccattttgtacccaagcatcaatctcactattgatagcaggcgcactgggtttcataaaatcataactcaaaacaaataatccaaaccgactagataattggctactcacaagacactatcatttcggacacaacgaatcggtatagcattttttactaatgatagcgccatgctataaaacatcggaaatgaatccgaggaataaaaatcaagtgcctctgtactcatctgtgtcgcaaaatatccctatctgaatagctcttcgatgatacaaaatcgaatcactcaaagctacttctagatgcaaatcgttattgtgtaaaaaatgatattgcggctctttcatatttcacaaagtctggaacatattgtttaattgagtacaacaggtttccaaaatcgatttgaaattatctactgccggacctttttccgtcgttcgagggtacaagctattaaagacgagatttggccacttatagagcttcatactggtgcactgtaggatggaatagcgaagcaatctccgtctcaaaatagtttttctgataaccttaccaattatacttcggattgttttcaatcgaatctgctaaaaaccacatttgtctattcggtcatttgatcgactcctgcatcaaaaaatattcgtcatacgccgtctcaaaagttaattctgtgaatttgcctcgatacatattcggcggctgactagttctcgtccactttttgaaaatatagccacccaacgaaggaatttcattaaatttaccttctggactaatgattttccattgagtgtaattgatcaagctatagatggaaatatagattcgcatagcctgtgcgtattttcgctgggaatattctttgatccaatcagccgcctagaatagttcgagcatacagataagccttcaattccgcttcctaataatgaccttacaaatcttcttgtagtgaatgccaaggcgtatggcaatagagttagtactcctttttgaatcacactgagtaaccggaaaaagtccaaaaaatctggctcttctaaatgaatcacccatcactggctttaaataaactttctctaatatagtcggcagaagctatcatgagcacatgtagggggagtctcctccatagcagacgacttcgccattttacctccatcgcgcctcagaccaatggtcctaaccgtcctatttaccatagagatagtacttgtagtctcctaaagcaatccacgtcatcaaatgaacaacatatccatgtttttaaacttttagatgcgttcaaccacaagcggggcattgacataagtaatcacaaaatataagttaatatcgatagcgggattccaaggctcgatttcttgatagctggttaactcttgattttttctctagtgaaagaaatagtttacttctttaattgggtttgttctctatggatgattttcatttattttacagttcaaaaaatatccctgccgctgacgatattgtaatgtctcaaaaagttagttttcttagtctaactttgggagcgcttcatattggttctattcggctgggctattttttatcaagctgcttaactcttgaggtatcgcctaataacacatcagtacctttactcattttgtcagttgttcataaacaaatattagaaatttttttatctttaaagatggtcggtttaagatttcgtaaaatgatcattgccaatataaggaattttctcttgtaacctatcaaagcgtttcagcatcatccccataaaagaatatgctggcaaactaatacctaaaaagagcaccaataatggattggttatatacaacaaagcagcaacacatgccatgatcactgttactacagactgcaaaggattaataaagagaaataagaatggttgcaaccaaatcttactaccttgaaggtcaaaatggacataaaccggaaacaagaagattcctgtcattacaaacaacattcgcgttgccttcaaaacaagttgcaaaataaagtcatcctgaccagcaccatttatcaaggctgtctcgaaaaataccaccacaactaaaactacaaagccgatggtaattagtaaactttctttgaaaatatcatgataaccttctttaaattccgcataaatcttactctcatattgatttcgtaaacgattacgaatacagccaaaaacggttagtgtagctggtactacaccaaatatgacacctcctctaagtgtaaacagtatccataaaatgttcaacttcatcatatagtaaatgtcattaataatgactagtaatttatttacaaccattgtaatctaccccttaattgcacctaccatgatgcctttttcaaaatatttcgctactactggataaaacaataggactggcaatgtggacacaactacaacactgtatttcaaagtcaacttcagcatcattgtttgggcacttgcactatccaacaaagcctggctggtatctccaaactgaccttgtaccaagatttctcgcaaaactaattgcaacgggaatttggaacggtcttgcaaataaatcattgcgttgaagtaatcgttccagcgagcaacaccataaaacattgccattacagcaataattggtgtggacaatggtaacacaactttccaaagtaactgcatatcattagcaccatcaacataagcactctcaataagttcccccggaatattttgttgaaaataagtacgcatcaaaatcatgttataaacacttaacgcccctggtaaaatcatgacccaaatagtgttaataatacctaattgctggtttaccaagtatgttggaatcaatccaccactaaagaacatagtaatcgtaaaaaagagtgtgaaaagtcctttcccacgaaattcaacgcgagacaagggatatgcacctaacgtcgttacagcgatatttaccaatgttccagaaaaagtatataacacggcatttctaaatccgaccaagatatcatcgtttttaaggatttcagtatacccgtctagagagaatcctctaggtgttaacaatagtggagtatcaaaaatcttcgtcggatcactaaaagaagcattgactacgaaaacaatgggatagagaattaatattgtgaaaatcagtaaaatggtgatattcacaatatcaaaaactttgtctcccttagatggtcgatatatagctttagttttcgccatttaaactcaatcctttcctatctcctaccacaaacttgtttcaccgacacgacgggcaaattggttaactacccaaaggaagatgaaattaataacattactaaataaaccaacagccgctgagaagctgtactcaccatttaccaaacctagtttataagtataggtagataatacttctgaggaagccaaatttgaagcgttttgcattaagaaggtcttatcaaagccaactgccatgattccaccagtagctagtatagaagaaataacgattgttggcataattgctggaatcgtaattttcttaatacattgtatacgacttgctccttcaagatacgctgcttcatattggtcttgaggaattccagacatagctgctgtatagatcaacgtactccagccaacactttgccaaaccccggaccagacatacatatgtggaaatgttttagcacttcctaagaagtcaatagcatctccaccaaacatttcgataatattgtttatcacaccattttgagaaccaaaaaagaagtttatcatccctactatgataaccactgagataaagtttggtatataagaaatggtttgaataaaagacttcaatttcttattactaatttcattgaacatcaacgccaagataatcggtaagggaattgaaaccaataaactgtataaactgattcgtacagtattccagataacgtttataaaaaaatatgattgaaagaagcgaataaagtgtttaaatcctacccaaggactagcaaaaataccaaaagctggcgaataatctttaaaggcaataattacgccatacattggccaataattccaaatcacaacaaaaaaaactgggattaaaatcattaagtaaagagatttgtgtttcttgatgtactgccaactctttgcccgctctttctttttaatttttttcgggctacttttcatatctgtacctcctcaaaagtgtatgaagcatcattctgctgattgataggagttactcctattaatcagttacggtgataagattgaacaatcacggcgacctttttgtcccgtgactgttctaacttttccaaaattttatagattgctggagtcatcttacatttttatattagaaacaaataaaataaaaaattatccaaagattcacaatacaacttcaacatcttactcttccatgtaacgagcatattgcgcttgacgtatttccacccatttgtccaaaccaatatttttcaattgagtcagatattcgtcccatttttcgtctacatcccatttaccagtcacgaattgaacccgagcttgttcaatatatttgttcatatctgttgtaatcgtagacaattctgaagtttcttctgacgtcgacataaaagttggtaaaataacttctggtagattttccaaaggtgcatctgtgtattcttctggttttcggccataggcaatttctttttcacgttcagttggttcattgtatggatagaaaccgccatatacattgtccatgaattggtatgctcctaattgaggaccttttgggtaattcaaaatcttgtcaacatatactttgtcgccattttccttcgcttcataagtcacaccttctttaccgaagaagccaagctctgttccttctggcccatagaaatagtcaacccatttaattaatttttctggatcagctgcatctttagtaataacaaaggagctagttcccatgacagatgattgggtaaccagagagccacccgtgccatcaggaccattcaaaatagttgttggaacataattgttcattgcttcagttccgataaagtcacgacctacccatgagaacataccaacagtatctttactagcatcagctacccatttatcataatccacaccagcaaaagcagttttggcaatcaaaccttttttatacaagttggcttcgtatttccaaacttccttcatattgttagaagagaagacaaattgtaatttcccatttttatccaagtaataattgttttccatggcagttcgaccagcagagttcaaaccaaatgcggattttaccatcaattctaacggtccaaattgtgcagaatccatatagtaaccttgttcatccgctttcccattaccatttggatccttagttacgaacgcttccaaaacttcttccaattctatcgtattggttggcacttctaatcctaatttttccaaccaaactttattgaagtacatcttgaaggaacgaccgccacccataggatcagaacaagtataaggtaaagaatagatgtgcccgtctggtgaagtgatagcttttttgatagttggatcttcttccattaatttaaccaagtttggtgcattatctttaatcaaatcttccagcgggataaacaatccttgttcgccatattttaccaactcttcatttgagaatcctaaattataaaaggcatccggcaaagtctttttagagataatcaattgtttcttatcttcccagtccttcacctcttcccagttcactttgataccagatattttttcatattcattccacatccaaagatcttctcgtttgggatggacgtcagtcctgtcaggtgccatcaaagagatagagccatcatcttttttcttacttgattctccagtttcaccaccacaagcagcaagacttaagagtgttgccgaggcaatagcagaacccactaaagctgccttccattttttcattactttttccctccatcataaattaattaactaaataaccaaaaaaattagaaatgagcataaattttattgttactatcatatataacacataaaaattattacccacgtaggttatatatcaaatagtaatgcctttaataataaatgtcaacgctttctttttttatggaatatatgatattctgtatataacattagaacaaacaatagttttagacaaatcaacattgtttttaatggtaatgataaaaaacaatttttattttaaaaaaagtctttatttctgctgtaaatatcagaaaataattatctttagtattttaataagctacaatattgaaaaaacttataaatttacactttattaaatgctaaaaaaatttagcaaagatataccacttaatttcttcaacagaaaattaaacgaactatgttatcatagtaatgaagaatttcaggaggactaatttatgaatacatctctttatgtcaaggtttacaatgacctgaaagaaaaaattatatctggagtttatcagattggggaaatgattcctacagaaaaagaactcacagaaatttacgacgttagccggattaccattcgacgggcattaactatgcttgcagaagatggcattgttgagcgaaaatctggtgtaggtactttcgtactagaagattgccaatcaggacgtcctaataaatttatcggcttgattttgtctggcctaaccgacagctacggcaaacatcttctacagtccatagtagcttccgctgatgcaaaaggatacgaattaattttaaaacttactgacgaaaattctaaaaaagaaagcgcattagtggacgaaatgattgcattaggagttagcggattattaatcgaacccgtacaacgtaatttctataatgcaactttaataaaacacatttatgccgactttccaattgtcataatcgataaagaactccaaggaatcgatagtctattcgttgggtctgatcattacctcggcgccaaagatagcgctcaaatgcttattaacaacgggcataaaaatcccgtcataatcggctacgctgaatttcgaaactctactttagaaaaacgaatcgatgctttcactaagacttattggcaatcaaatatacctttttccgctaaaaatgttgcacgaattatcactagcacttaccagtcaacagatatagatacatttcaaaaggatgtatattcaataaagaaaaacctacaaaaatttgagccatcttgcgtcgtttccctcgatgcccatgtgaacggacttgtacaacaagctttatgggagcttgacttacgctatccagacgatatttccttattcggatttgattctgcaaactcctcattcattagtaccaactatactcatctatctcaagatgaagaaactatcggtgcaaaaagtgtcgaagttctagacaaatcaattcgcaaagttcctatcaaggaccatcgcttattgattcccgccacactcaaagattttggaagcatcagtgtcttgaaatacaacctatagtatcatttagaattggatatagattcgcaaataaaaaactcgtcgtatgtgagaagtaaataggtgtgtaagaaaacactcagaaaattgaagcgacctccagaagttagacctaaaatctagcttctggggtggagatgtcaagtaaaaatagatacttagttaagagaataagtggaatatttttcaaagtctttaggagattgatagcccagggcagagtgcatgcgttttgtgttatagtaggtttcaaactatttaaatatctcaatttgagcctgatcaatatttctaaattgagcgtcattgatcagctctctttttatcgttttgtaaaaagattccattaaagcattatcacaagggtttccttttcggctcatagtagagcgttcttctattattcttagcaccgattggaatttagtacttgtgtattgcgagccttgatcagtgtgaataaccaccccggtccaggctgctcttttccaaatacttgaagaaaagaatccacaactaattgatctttcattctaagtgacatagtccacccaacaatttttctcgtatagacatcaataaatacagataaataaagtgctccttctttcagagggatgtaggtaatgtctcctaaccaaattttatttttttctgttgccttaaacgtttgattaataagattgggtcgtgaaagagagggcgattttcgattataatacttgtgtttataggtactgcctttagcataaagaccaagctgatggagaagctttcttacacgttttcgattaacaagaattccttttttatttaataattttgttattcgaatcgctccatatcttccatgatgttcctgaaaaatagtagcgatttcttctttcaagagttcattctctttttttcttttggatggttttcttttaaggaactcataaaaaccagcttttgaaacgttcaatgtctggcaagctctccggatattcaactcatttttgtgttcttttaaatactgaaatcttacttcttgtttggcttcaagaagacctggaacttttttaataagtctaattcctctcttaggtaacgattttcttgttcgagtttctttatttcataatgggcatcaaaaagtgcgctcccttttccggggaacgcactttctccatatttttcaacttcttgaacccatcgatacaagctattagcgtgaacttctagctgtaggctaacttctttaacagaaaatccttcttcagttaccagttttacagcggcgattttaaatgctttatcaaatgaacgtcttagcataatctagatcctctctttcccttaatttattgtctagtttattataccaagtccaggcgccgacctgtatcaagtacagtggcatgttctttaagtatttgaagcaaaatctgtccatcaaaaagctgtattctcaaagtgaacagggtgcgctaaatcaggtaatacttacgctgatcatttcttaatttacctacttaaccaaaatttaaatcaatatgaaagcgacacttttcaaactaaagaggtcttttcaccgcttgatgtttgcttcgataaaaaagttgatgtcggattagttttcattttaataaaacatactatttctgaaaaaaatttatccactgctaagtattcggatttttctaatttttaacaaaatttatttcggaattttctgatattatcttcgcaacattagtgaaaattcttaaataaattcattctttcaatctccgaattttagatatatgtgaaatatctgttttttgaatgtttgcataagttaaaagatgagcgtgctttagtattctttagaatagcttcttatacaggggcacgaaaaggagaaatactcgggctgacatggagagacatagatttcgataatcaaactatccgtttcaacaaaacgttagtagaactatccgatggctctctatgtattaatcctacaaaaacagacaaatcaaagagagtaatttcaattgataacggaacctcacgtattctaaaaaaatggaaacgttctgtaataaaaaagaacctttctagggggattcggatagataatatagatgatatacctgtaatcagcactatcaaagggaataaaaaaagggacttcctttacaaagtctaccctaaccatgtcatggataaagtagcacggaagttcccagatatgaagataatcaaagtccatggctttagaaagactcatgctacccttctctttgaagcaggtgctcaagtaaaagatgtacaagataggctaggacattcttcttctaaaacaaccacggacatttatattaaagtatcaaaaaatcggcaaaatgaaacagtcgaattatttgagtcttacatgaacggatgataagcgaggtcaaaaacggggtcagaggatattatgaggatacctttttccctcttaatcctttaatatcaatactttaagcttagacttttgcaatcttcccttgttcgatataagactcaaatcactatatcactagatatcaaacggcttcatacggagtcaaaaacatcaaatgtggcctgttaaatggtcattgaataacatttaaaatcaataaaacggagtcagacacggagtcaaaaacgctgagagtaaaaaaatatatacagccctgtggcactttacctatggggctgtatatttttttatttcatattacctgaaacgattccatttactttttatctcattttttcctactagttagtatcaaatactctcctattttctcaataaactattttcggctacatggtatctgaaacagctaaaaccttgtcattacagcaaaaaatcactttatctctgtttcatttcagatacatttcacttaagcggattccaaaaaaacaaaagaaaaaggaacccctagttagcctatgctttctattggttcctcttgagacacgttcatataacaacggggtagggtaaatgaatgaaaaagatggaggaatcattatttaatagctttcttaaatacttcgttataatcaattacctgcgcattattaagtatcacagaataatttttttcattttcaagtaacctaagcgggttgtctttactaacttactctgatactgcattactaactctcgttaaattagatagcaggtctgataaagactaatttcttataaaaatttttatatcagtatttataataattcctttaacttcatttacatgattaccgtttcttactgacataatcatactcggaagtctaatttgttttgaataatttaaaaaatgaaaattacttgtatactaatcaatctcaaactaataaggttaaactaattttaagtttgtgtagtgcttactgtctatatacattatttgatggctaaattcataattttcaatctctaaaataacttgaataaaatcaagagtttatcatcatctttgaccagaagaatctttctttttagtcttaattctcttttgtaaaaaagaattaaagacaacaatgagaaaccatctcaagtagtagtcttaaatttacattttatgagattcgcactataattgaaggaaataaaattaaaggaggaatcgtaatgaaatttgaacaaacaaaagaagtgttgaatcaactcgttgctgacttaagtcaaatggcaatggtcgttcaccaaacacactggtacatgcgaggacctggctttttaactttacatccaatgatggatgattttatggatgatttgaacgaccaattagatgtgatctctgaacgcttgatcacattagatggctcaccctactcaacattgcgggaaatggcagataatacacaaatccctgatgaaatcggtaactgggaccgtacgattccagaacgtttagccacacttgttgaaggttatcgttatctagctgacttataccaaaaaggaattgaagtcagtggtgaagaaggcgatgattcaacacaagatatctttatcggcttcaaaacagataccgaaaaacgtatctggatgatccaagcgcacctaggtgaagcacctcaggtagatccatcaaaatcaggtgctcgttattgattgatagagacaaagaatgttttctaatcaaaatgtacaattctattaaaatccggaactggaagtgcgaacttctattccggatttttttgcgttacactattagataatagaatttctcttttacttagagagatttgttactagcaaagaatgtttttgtgataaattggttttctttctcatgatttttaatacatttttacccccaaaaacaaatagactttgaacaagaaacatatgaagatgttcaaactcaaatcttttcattttgaattttaatttcgcggttaaaattatttaagatattatctatcaataccaacaaagatttaaaacctttcctccatattttcttgttaagtccttattctgctttagaaaactcatcaaaaaagagatgcaggaacttcggatggtggtttaggcttcttggctgggatgggcgcattagtaataacccaagagcaacaaaaaccattattttctcgaaagctatttaactagagaatactttagagaagttggcaaaagttgaattaattgtgctgccagatgttacgaatccgtaagtaggtgcgaaataattttttatgattaaaagagttgttcatggttaagcagtcgcaaatgggaaaacaggagtaaaagcgattaccgataaaattatagaatacaacaatcaaagtggcgctttaaatgagtctgatcaaatcattgattacgcaaaaaagcaaattaagagggaacaaaatgttcggtgtattaaaaaaaactgaaacagaaatattttcaccagtaaatggtctgcacgtgttattacatgtgggattagatattgtggctcttaaaggcgagggctttagcttgcttgctacagaaggataaaaagtcaatacaggggatattcttttgtcagtggacttagaagtttaaaaaaataatgctaaaaataacacattgattctggcttttcctgagcaaatcgacttgcaactttccgtcaatgaaggagtagtaacaaataaaactgttgcggtaactgtaagataataattactatataaaagttttctctagttatcaattcaagaaatttgtttgataatgggcgttagtcatgataatcaacatagcattacctccactattatttccgtttttttagaattcattgctttcttaagagcacgttctttttcttttccgtgcttactccattaataaatgatgagcgtagctgtgtccttcttttacaccagttaaaaactcagcagctttttgatcatttggataatactcaataggcaagtcgctcatagatacatctactagctcaatcaataaattctgaaaaccatcttaaagaactgaacttttgactaagccaattcacttgttgaagctgcaatagatagtaatgtctgatcaatatctaccgcctatacctgactcttcatactcggtaaactgtaagttcaagacacccgtcagtaataaattcccaatatcagaagcaatatctaataatgcaacagtttttttgtcggtaaataactattcaatcagatagaaaaacagataactaatgatatcggctgttaactgatgattcggccgtaaattctcttttttacttccttttaggagtaaaagctgacttaatttttgccattcttctgattctagatgcgttttttatttgctgataaatcttcatcactctttggaccgtctatttatctggctaccatcaattactcgcacttgatgattgtcaatcaaattctcagcgttttcaatatacgcgtctaaaaaaatatccagtgcattttaaagcagtcggatagcttccacgtttaatgtaaagacttgttcaattttttcaggaaatatcccgcacctcatttcagaaaacaaactataacaatttttatacctatttaattctaacgaatatttcaggagattttagtctatttagatgttttcagcgcttttgtttgtgaattaaagaacaaataagttagttttaaagttctaagaaaagaaaagagcgggacataattattcaagttatatcacactctcgtataatcttattaaacagcacagaagaaacacatctccacttcgttttgccctcaacaactgctacgcatgaaatatattaaaagtgaaagctaggtaaataagttgaaattgcattgaaacactattactgaaagaaattgatgttgaaacataccaatatgtgttgaaacttttcttttactagcttgtcataattttgcgtcagttttcctttaatagctgttgatgaatttggtagactgccccaatcattcctgcatcattttgaagcttcgcaggtctcactttcgcaatggtttgttcttttaaataattaatggattcatgtcgctgaatcaactcaaaaagacgttcctgaagtcgcttgttgaaggtttcattagaactaattccgcctccgattaatacaacctcaggatcaaagcagctaattaaatttagcagccccacagataaatcagtaaaaaaacgagagagtatctcgttggctaacgcttcacctgatgcttctctttttataatttctctggcatcccagacatcttcagacgctgaatttctttttttctgtgccaaattgtattgatagcataaaccacctactgttgcggcttttttgttcaaagagacttcttcaatatctcctgtcacaggaatctcatcaataaggcaccagccaaattcgcctgccattccatgacttccacgaaatacctcgccattaatgattattcccccacctattcccgttcctaaaacaatgcaaaggtaattatccatgcctttagcgttgccaatccagcgttcagcaatcgcagctgcatttgcatcattttctatacttacaggtaaaccggtaagtctttccagttccaccttcatattcattccataaaatggtttgatggctcctgccgttaacataaatccatctttttgaataattcctggtgcgctaatgccaattcccttaattgttgaataggttcgtttgaagccctctacaatctcgtgtaattcactgacaaacgtagggaagtcataatttgtgggcattgattttttttctaaaatcgtccccgtttcatctaataccccatattttacatttgttccacctatatcaaaccctacgtacatattctcaacttctctcttcggtaatatcatacttcttaaaaacgttcattaaaatgttggcattaataaaaataacggttccgataccagtgaatagccaaacaaacaataatttaggtaaatagattggtacaataacgactcctccgatagtaataaaaaacacaataatgctttgtggtaaatgtttaagcgacaaaatcattgcatttacaaccgttccagacaacgaattatcaaatcgagcaatcaatggaaatagatagagactcatcagtaccaaaaaagtgataaataccattgtaaggtagtaggcaattttatttcccaccataaagctttgtacgtatggaaaagtccaaaaacctgctccgataacagccagtatcaacacccacagttttgttgccggaagcatatttagctttagctgccgtaaatattctttatacagcacaccttcactatgatctatcatcttataggcagttccatatgcgctcgccaaagccgcaccaatcgtcaccacaggcaagcaggagaagataaaaatactattcaaaagtaaaatttgataaattctttccattccactataaatttttccttctgtactaaaaattttcgacatactcctgcctcctcatttgttgtcctttattatctactcaatcgtcttacaaacctaattttttcttattttcttcaattttttcattacgaaccttgtttacatcatcaattttattatctttttggaaattcttgtagtcttccagcaagctatctaattctttttcatcctttgctctaagcatgcccactaaggttgtactccaattcgtttgaatggcgctcaatgcacgcgcttcttgtgttccagcatccggaccaatattttctgttgggaattgtgatgtaagtttaccatctccccattcttgcatttgtttcacagcatctacataagaagcatcattcatcgctttgaaacggtcatgaccaaactggatgaattcacccatacgatactctaattgccatttttcaggatcatcttgttgaatttttcttgcttgctctgtccattgtactttattgtcagcttcaacagtatatgtttccccttcaataccaaagtttgtcagcatttctccttcatcactcaatagatacgtgaatagttgaatcgcttttgcagggtccgcacagtctttaccgatatagttaatcatccatcctgaaattcctgcttgtgttaatgttggcttgtttcctacagtactttgaattccatctatagcaatgtattcagcatctggattgtttgctttaaatgtttgcaatgggattccttggttaacaaaagaacccagcatgaccgttgcatatttacctgtttgaagtttttctttaaatttatccccatcatctgtaaacgtgtcatcagagatattgccatcttcatgtacttggcggaatgccttcacccagttgatatagtcttcgtctaaattacgatcataatattttccatcttttgtataaggaacacctaacatatcttgtacaacaccatccatagagccattagatgagccatcttttgcaaaatcattgaagccaaacggaattaaatccggatatttctctttaattttactcatgccagctgcaaagccttctggtgtagtgaaatctggttttccaattgcttcatacacatcttttctgattacgaaggcatctcgtgcaaagatgtccccactatcaaaatcactttgtgtatttgaataaccaggatagccataagattttccatctgataatttataccagttcaacgtttcttcacgagttacttcattgaaatacggatcgtaagtttttgctaaatcttgtagtggcaatgcccaagagtctgctttacgggcaacttgagaatttgaatcaaaaatcgttacgatgtccggcatatcccctcctgcaaaataggtatttaacttggtgtcatctcctgtaataaattcaatatcgatgttcagatcttctttgattttctttgttaccatatcttttccatattcggtgttccaccagtctgcattaacataccattttaatttagtcgtttcctttttcgtatctaattgccaagctggcgtttttgcatctggtgtatagcgatcttcaatagatggtaaacttacctctttatcttttgacgcctctttgttatttccacaagcacctaataacatcacacttgccaaagcgagtgtccctacaattttcttttttgataacttaaacatttccttctcctcctattcttttactgccccaagcatcatacctgagataaaatgtctttgtagcaatggatagataattaaaattggaacggtcgtgacaacaattgttgccagttgtacccccttagatgttgtgctgatttcgaccgctgcatttaagccttgttgagatgctgcctgagattgcgttataatttcgtagagtttcatctgcaatggataaagcgctctgtctgtcacatatagcttggttgtcataaaatcattccattgccacactccatgaaatagggcaatcgttgctaaagcaggtttagataatggcacaaatatttttagaaagacgccccaatcacttgcaccatcaatcttggcagattcctctaaagacgtaggaacatctctaaagaaattcatcaaaataatgacatcatagtaacttaataaggctgggataatatatacccaaaacgtatttaacaaatttaatgatttaatcaatagataagtaggaatcattcccccagaaaagaacattgtaataattcccatggtggaatacagtccgcgacctttcaaattccgtttagataaagcgtaagccataatcgcacaaaaggctgtatgtgcgaaaacgccaatcactgtttttcctatcgagataagtaatgcttgccacattgatgcatcacctaatacttttctataattatctgttgcaatctctgaaggccaaaatacaaagtctccttttgctagcgcatcactggatgcaaaagaagaagcaacaatattccaaacagggacaatgataacaatggtaaatactaacaataataaaatattgacaaagttaaaaatcttgctgtctttatcttgaacgacattactctttggttttgctaatgataagctgctctttttcatcgtgtccctccttaaagtactgattgattatcattcagttttttcgtgataatatttgttaagaccaataaaatcaccgagataatcgagattcccaatcctacagctgttgcataagaaaaatcaccttgcattaaccctactcgataaacataagagttgatgacttctgcttttggctgattttgtgaattcattaagactaatgtttggtccagatttgagttaaacaacccgctgacacttagaatcagatttaatgaaataatgtttcgaatcattggaatagtgatactccagatttgacgaagtctgctggctccatccatttttgctgcttcataataggtaggatcaattttagacatcgttgccagatacaaaattgttccccatcctgcttctttccacacatctgacagtgaagcaatccaccagtacttgctgacatctaacatatgattttgttttgtttgaattccaataaaattcaatagttcattaatcattccattagaagaaaaccaagtaataatcattcctcctaagataatccaagataaaaaatggggcagataagagatagtttgtattactcgtttaaatacgctgtctcttagttcgtatatcataaccgcaataataattggcagaacaaatccaaaggctagtttcaatccactaatgcctaatgtgttaattacggactcccaaaaatatttatcctccatgataatccgaaaattctctaaaccaacccactgtgcaccatctattgtgtctatgactgtgtaatttttaaaggcaatcactaagccataaatggggataaaactaaaaataatcatgtaaataatgccgggaatggccatggtttgcagctgccattgatgaccaaagtctttccaccattttgaaaaacgactggttgaggttgcttttgcgttctttgcttccaccctttttcctccttctttttgcttcattctttgcttatatctaacgactcaatcgtttagttgtttctcgtaccactaattgacaatccaaggtcttactttctccttttttttgattgttaattaatttcatcaactcaattactgcttgttttccttgttcttgtatcggattttgaatcgttgtcacacttggcttaaagtaacctagcagttcaatatcatcaaatcctattacactgaaatcctctggcacgctcattcctagctcatcaattgcctttatgacgccaatagcagacaaatcatttcctgcaatccatgcagttggccatttatctcgtggggtcgtcaataaataattcttgatattttcatagctctctttttcttcaaacaagccggtaatcgtccagtcgggatttattggcagttgatgctcagccatcacttcctgaaaacctagataacgttcatcactgtcataaacattagggtgtcccggtaaaaagccaagttttgtatgaccattttcaattagatgctgtgcagcaattcgacctgctttctgagaatcaaagaccacactgctaatacttccatcattgattttccgatcaacaaatacagccttcacaccctccgcacgaatcgtactcaatgactcttcatcgattaattcttcaaatccgataaatccatctaccatatttcctaataagtgagagctaagaatctgtttatccgaggaaataagtacgttcaccccatattgatagttaccagcttcctcaacaattgcttcaatcaacgtattgaagtacggacccgttatggtatgggtataaagcccaatcatctttgttgtttttgttttcaattgttttcccattaaatttggggtgtaatgaagttttttcgcggcttccgtcactcgttctatggtttttggtgttactacatccagcccgttgagtgctttggagacagtcgcaatggaaacattggcttctcgtgcaacctctcggattgttactcgctctttcatgaaatccctccaaataaaaacgtttttattttcagttaataaaaaaagaattctttttaatttatagacaaagtatagataaaaacgttttcaaaaacaatatctaacagcaagtctggttgctcaactcttcgttttgaaaaaacagtcacggtggtacagcctgtaccaccgatacacctatcctacgtactcaaaggtagctgttgaaagttctttttccgcactagtacctaaaaataaatgaaatgttcctttatctgttgttcgagccaaatcactatgcacataagcaaaatcttttgcctcaacaacaaactggacttgccttgtttcacctggatctagagatactggctgccatgcaagcaattcttttttcggacgaatgatttgcgtaaatgcatcttggaaataaatttgtggcaacgtatagcctgcttgattagatagatttgagacagtaaacgataaagtaagttgttcatttctagttaattgcttatttgaaagccttaaatcagaataaacaaattcactatagctaagtccatgaccaaatggatagagcggaccattttcttcatctaaataacgagaaatatacttttgatctgcattttctgcagtctttggacgtccggtagacatttcttgataagaataaggaagctgaccgacacttcttggataactcattggtaaatgcccgctgaaatttctctcaccactcaacaatgaggctaacgctgttcctgtttgacttcctaaaaaccaagcagagacaattgcttttacttttggttctacttctgttaaaacaagcggtctgccgctaaacgtcactaaaatactctctgtattctttttatagatggtttgaataactgttcgttctatttcacgaagcgtcaagtcagttcggctagctgcctctccagcttcttcacttgtttctcctacagcaatcaccactttatctgcacggctggctgcttcttcgattgcctgccagtctggctcttcatcggtaatcggaaggatttcaagtgttgaaacgatctttttcataccttctgataaagaactcgcagcctccatctcaccaatccatgaccaagcacctaatacatcccttgtcaccgcttttgttcctaccaatagaattttttcttctttttttaagggaagaaccccttcatttttcaaaagaaccgcacaacgaactgccgcttcataggacgctttcgtcaactcttccaaatcagcagtcgtatccaagccacgataaggattttcaaacaaacctaactcattttttaaggataaaacacgccaaacagacgcatctaacgcctctgttgcttgtgtttcttctacaatcgctgccagttctttcaggtagcaatccgtcatcatatccatatctaccgacgtttcaaacgctttttgtgctgcttgttttgatgtttcagctattcgatgcgccttcaattccgcaattgctgcccagtcagaaattaaaagcccttgaaagcccaatttcctctcaaaacattttgtactaaagaagtatttgcggtaacaggcaccccatgtacactattaaaggaagtcatcaccatttttacgccttctgaaattacgccttcaaaagctggcaagtaattttgatagagctcaacatctgaaacatcgactgtattataatctctaccgccctcagctgcaccataaccaataaaatgttttacacatgcagctacgtgtgactcattttttaagttctcgccttgatagccacgaacatacgcttttgttaacgcagttgataggcgcggatcttcaccgttactttccaagactctcccccagcgtggatcttttacatagtctgccattggagaaaaagttacatgaatctcttctttcgctgcttcttttgcagcatgccgtgcaacattttctattaattctgaatcaaaagaagaggctaaagctagaggaataggaaaaatcgtttcatacccatgaattacatctgccataaacaacaacggaattttatgcctgctgtgagcaagataattctcttgaatctttctcacctctgttgctcgatgcgttcctaagacagaacctaattgatataattgttcttcatccattgaccactgagtcataggaccggtcacttcgccttgattcccaaaaaaatctggagtcacttgcaccaattggccgactttttcttccaaggttaaacttgataataattttttcagttcttcagttttcatctttattcctcagtttgattcttaatcagttgtttataccactcaaaagaatctttctttctacgtgctaatgtcccatttccttgattatctttatccacatagataaatccgtaacgtttttccatttcgcctgttccaaaactgacaatatcaataattccccacggtgtataccctaataattcaataccatcaacattcactgctaaagccatttggtcaatatgtttttgtagatactctactcgatacggatcatgaatttttccatcctctaacttatcataggcgccaaatccattttcaacgataaacataggtaaattgtaacgttcataaatgatatttaaggtataacgtaagcccacaggatcaatctgccagccccaatcacttgcggttacatatgggttatttaccattttcgcaccaggatattcttgaacaggctcaccctgaacatcctctaatgtagtcactgcacctgacatgtagtaactaaacccaacgtaatcaacctttccttctagtaatgcgctctcttctttttcagatatttcgatggtataacctttttgctgccaatacttgcgtgcataagaaggaattttcccacgaacatgaatatcagagtaaaagaagcgacgattcattacttttacagaagccattaaatcctcaggacggcaagaatacggataaacaggaacgtatgccatcatacagccgatttggaaatctggatttatttcatgtcctagcttcacgacttttgcactagcaattaattcatttagtcctgcttggaaagtaatttcttccttattctctccttcttcaaaacgaatagctgaatttgtccatgtgtgtaaatcatgctgaccgtccgcttgattatttatttcattaaaggtcatccaatatttcactttgtctttgtatcgcgtcatgactgtttgggcataatgaacaaagaaatcaatcacttgcttatttctaaatcctccatatgtttcatacaaatgataaggaatttcaaaatgagataacgtaataacaggttgtattccattagctaataattcatcaaacaaatcatcgtaaaattgaagacctgcttcatttggctcactttcatcgcccaacggaaaaattcttgtccagttaatcgatgttcgaaacgctttcaatcctagttctttaaatagttgaatatcctctttatagtgatgataaaaatctatcgcctcatgattcggataattttctccttcaagaaccccttctgtaattttgcgagcaacaccattggctcccgcagtcatcacatcagcaatgcttacgccctttccgtcttcattccatgctccttcgacttgatgagctgccactgcaccgccccataaaaactcttttggaaattgtttagtcattacatgttcacctcgtttagttgttactcacagtataggggctgattttttgggtttcaatattctacagccactctggttaaacagtaagcaaatagaaaaaaacaccacgttggtacatgtcgtaccagcgtggtgctaaaatattttttcttttaggttttcactcttgtaatctattcgctaactgctcaattaaaaagatgcatggaatctgactcgtcaagtcttcatgtttttttacacgctttatatctacgtgataatctaaaacaaaatcggacattttagcaagcggagaattaatatcagccgtaatagcaactgtcgtgaaatcatctttattccgaaaaccattcacaatctcaacaacctcatttgtcattccagaaacagataaagttaccaaaatattatcgcttgtattttttaattttgacagaattggatacgtaggatcaatcagagcagaactattatagccaatcgatgcaaaccttcgagcagcatattcacaaatagaacctgaggcaccaatcccaaaaaagacgatattctcacaatactgaatcttctcaataatctgatttagcttactttcaatgtttctaggaaaatgatttctgcttaatatatttaacgcatcatcaaatcggtcactttcaacagattctacactaaactgactgcgaaattctgtatagctttcataacctaatttacggattaatcgcatcactgaagaagcggacgtgtgggattcttttgcaatatccctcaatcgcatataaggaactttctctacattactactcatatagtgatagattgcctgatccgtatcagataatgaattaaaatcaatatttccaaagaaacccatgttctctcccccgttttctataacgactacatgaccattactatatatcattctagcaaaaaatactagattttacgaaggttctgtgggaaaaatcattccctttaactagtaaaaatgattgagaaactcttttatgaaaatcgggtactcttactaagatcaataacatctttttacaaaaaagagcagaaattataagttgattagcctatttcgactatttccaaagctcattctttttgatccaacgtgagatggctgtttgtgagcccccatattctttgcataaactggattgaattttcccgccatgataaagattagctaagcttttttgaaatcttcatcatattttttgtaattggacataaacgttcttccttatatatttagattactcaattaatcagctatttcgttttatttagctgttattctatctataattgagttagactctgtggactagtacgttctccaccagattcctttggaatactgttaatgaaaggctctagccacatctctttgtcaaattgttaataagtttgttagcgcttgacgtctgttcgtgacgcttgattgatcacaaggttacatggcaaagagtgagtggatcacagcgtgaattttatctgattaggagtgatacttatgttgtatgttggaatagatgttgtcaagcataaacatgacttagcggttattgacacaaaaggagcgatttttattcgtcatcttcagattaaaaacaatcgtgaaggctttacgaagcttcaaatgacgcttgctaatttgcagaaatctaccggtgaagacattcaaatcgccttagaagataccgatcattattgctttaatatcttacgcttccttcggacgcaaggctacccaacctacagctataatccgtacttaattaaagaatatgtcaaaaatcaaagcttgcaaaaaaccaaaaccgataaaaaagacaccatgacgatcgctcgaaaaatacgaacagatcttgataaacaatcatttagtgctaacccttcaataattgagttgaagtatttaactcgacatacagccagattgaaagaggattatactcgaaaaaaagtaagctacacacgaattctagatattctctccagaactcacaccttctttgggttcttcttccgcgaaacaccaatcctatgtatacgcaatcttaaaagaatatccctctgccaaaaagctaggaaatgcacatttaacaaagctgactaatcttatttcagcgcactcaaagggccgctttggaaaagaacaggcggtcaagctcaaagtactcgcgcaagcctctattgatcaagagtccgccgtattagaatttgaactccttcaaactattgatgccattcagtatcttacaactatgcgagacaaagcaaagaaggaagttgctcgattaataagtgaaatcgattcgcctattttaatgattcctggcattggctataagttagggagtgtcattctcgccgaaattcgggatattaagaattttcgttcgccgaatcagctgcttgcttatgcaggtgcagaaccttccgtctccacttttggaatgaatcaaacggaaactcgacgaatgatcaaacgtggatcttcgcaattacgctgggcattgcatgagttcgccaggctcatgtctatttggtcgccatctatgcgtgtctacttccagaaaaaactagcagaaggaaaacactacaatgtcacaattagtcatgtcgtaagaaaacttgtgaggattatttatcactactgaaagacaataaacattatgagaagcagaaaatgatcattaactgatcttttcaaaaattccctttgcctagggtttctttgtcatgccttcaagccatatccaaactacgttattcagactttccatattgtgcttgacttaatatagtttgtctctcttttaggtgtcttaggttcagaacatttccaacaacgaatatctctgctagtgaagtcctgaaagcagaaattatggctaacggacttgattcaagttctgaacaagtaacaatttcagaaaatatgacaaaggacgaagtgttacactcgatttatatagaatttggtattttcaaagaacaagctgaacaagacattttttaaagcaacgcccgagtaaaacgtcaagcaactgataaaagttttgttttagtaagagtggctggcaaagccgccaaattaataatagttttgaaagcggaaccgcatatttttattgtaaaacaactgaaagtggtggttttagagctattaaagaaattattacgccgactttaattatcataagtatggtttttcaggaacaggacagtatggacttcccgatcctaatcgtattcactacacattaaacagagccttatacagtcatgcaacaacaagtattgcaggtggtggcaatgtgggtgtaaatggtgtaggaactgttaatcttagtgcaactgtaacaagcaactttatagaaaatgcttttgtgaccaaagattcaatgagttgcgtatccgtgaaatgaataagcttcgtaaagcaggacaaaaaagtcaggcagaaaaactgaaaaagaactggcactttccgctaaaaaatcgtgcaaagcaaacattaaccattacgaatacaaaacatggaaaagttttctagcacctaaatgcacgtttctatatgaagtaataatgattgatcgattttttggcttttccacgctctcaaaggaggcagatctcttttttcatgaatcagttgaagcttttcaagacaaagattccgacttatttttctccttattggcagaacttcccgaaacgttagataacggctttcggaagaagcttcaaaaccttttgacctatgaataaagcatcacaaatgcgatgatctatccttcctccaatgaaaataacaaaaattcctgtttttctatcaattcatatttatttaagaactagtttagttgattgaatatgccctactttttttgtcctataaatcttgtccgaacatattgttcaggtgcaaaatgaatctctgtatattcaaatatttgaccatcatctaaataagcccagttttgagttagtccaatacagttttcttcctgtagagctaaataatttttatctaaatcagttgctaaaattattctgtcaactaaacgtgagccaataattttatgatttgtgacagcctgaatgtatcggtaaattgattgtcctgcaatctcccttgttagtctaggtactacatctgatttgaaaaagctatcatctatcattacaggttgtccattaattagacgcaaacgaacaacatgataacaagtagtccctacttgaaacattgatcgtgatgcaagtgcagaatcaacaactattaaattcaacgaaagcaccttagtttcaattgaatctgtttgaatttttgagccacgtcccatatttccggaatcaattaataaatcttcaacaactactctttgtaagactatattagcactaccaagtttactgtatactagcccctcgccgtttaactgacgaattgcctttcggattgtattgcgagaaacgttatactctaactctaagtttttttctataggaaggatttgactttcatcaaactctccatcaagaattctcatttttaagtcttcatagattttttctgccttattaatttgaaccattttatttttctccaagaatcgaataattttttagtatataaccttccttctttatcatacaaatagtttgcgaatctgtaaataacttcaattctttaagacgagacgcattaagcgaagacaccttactaagctcttctgacatataaccaggatggcagatcacttcaacaatagaactattagcatcatcactacttatttttaaactttcatataaataatttagtgaataatctattccagcaacatttgcaattcgcttatcaggcatttttatccctgcattagttaaatagttatttattctttcatttgaaactctacgaacgggtacaccataaaaccgagcaattttaataatgatgtccgccattctataatcaattattatattcttatgataggttaagtgagttaacattaatccttgatttaacagatactcacactgagcaaaaaactctttttctatccaatcataatattcggatgttcttaccactattgttttattggggagctgacttccatcacaacatgaatgacctatctctaagttcaagtgaatccccatgtgctttatttgattcttttttgctaatctagctgcttcaacgcgatactctgatgtcgtaataaagtttgtttctgttattcctccagttgataagcccgcaataattccttctgttacactaggaactaaaccaaaatcatctgcactaacaattaagtaatgttcagttctcatgtgtaatctcttctttatacaaagcctcatctgcagctttaaaaaatggataataaattaccgtatcaattaataagaaaaatatttgtaacacacctaatttccagcttccttgtagcaacccaacaaaaaagatgggaataggcatccctaaaatcgatgctccagaaggtgctggcactagaccaattttaattacaaaatagccaataacaagattaattagtggtgcaatgatataaggtattgcatatagggcattaaaaacaatgggaataccaaaaattagcggttcattaatcccaaaaattcctgaagggagagataacttgccaagagttttatattgttcacttttagattgaaaggccattaaaatatttagacctagtgttgctccacctccacctatagaagtacataagatccaaaaagctaatccaacaatatttggaagcgggtctccattattaaaggcttctagattttgtaaatctaaaggcatgaaaacagttaacaagattggcatcaatacaagcattccatggatacctatcatccaaagtaagcgagagagcaatgttattaatagtaatgcccataaagaattacctatatttgtaatgggagtttgtataatcgtaaatataacctgatgaatacttccaaaagatgttaaagaaaataaatatcgaacaatcatagctaaagtaactatcacagctgaaggaaataatcctgcaaatgattggctcaccatgctaggaacggcatcaggcatttttagaatccaattatttttaatcatttttgtgtaaatgctaccaacagcaaatgctgtaagaatggcaacaaaaaatcccgcactccctaaccattcaaatccaatatatgacacttcttctacaactgataatggtgtcatgatgaagaaagcaattactgcaataacacttggaataatcgagtgtatgtcgtatttattaacataagtataagtaatactgataaccgcaattatcgaaataatactagtagaaaattgtccacccattgaaaaaatagttttaattccatgctccgaaataaaattttgataggaattaagagggaaatttgcaaataatgatgaaaaagctcctacaataataaccggtagaatcattgttaaacctgatgttaaaatttttaaaaaagtaaaactgtctaactttgcattaattttctccaaactctgtataaatgtaccatctgctttaaacatttaactctctccttttagggttaaccttttttgattacgtttacatattaggttaacccaatacatttgtcaagtttttgattacaaaaaattgatgaaataatacttgagaaaatgaaaaagatcatctttttgatctattaattaatcaaagtgacctagaaaaaatccgagtgagaatgagcttccttctgacccagatttgattttgcacaactcatcagtaccaaataaaaagagcatctttttttcaacaaataatccgctctaaaagagcaagacaagaaggaataaaatttaagtcatttatacaaaaacctggataagaatcaatgtttttttttaaaagatatatttttaatttaattatctttatttaagtaaaacgctataaatgagtgagagtgtaaaatattttgtgtaaatagaaaaaaggaagtcccttctgtagaatagagttaccacaacacattcacagaagagaggacttccctatgaacgattttactacagaaattctaaagactctagcgaacaaaggcgatttgaatgaattattccgtgtccatttggagaaagcagtcaatacgcttctcaaaacggagttaacggctttcctagattacgaaaagtatgatcgcattggttttaacacgggtaattctcgtaacggctcctatgaccgtacggtcaaaacnnncagatggtttaaccttggatatttggttacgtaaaaaacgggacacacaagcagcctatgcttttcttaagcggttagtgaagcagtttgatgaaccgaaggttgtagtcacagataaagccccctctattacaagtgcctttaagaaactaaaagaatacggcttttatcaagggacagaacatcgtaccattaaatacctgaataatttgatcgaacaagaccatcgtccagtaaagagacgcaataaattctatcgaagtttacgcactgcctctaccacgattaaaggcatggaagccattcgaggattatataagaaaacccgaaaagaaggcactctcttcgggttttcggtctgtactgaaatcaaggtattattgggaatcccagcttaaatcatagataccgtaagggattttattctttatttaaaactttgcaacagaacccttggttccattgacctctgatggattgcaggaaaaagtttttgctgaaaccaatggtcaaggggtagacctgtgtattattgccgcgccggcaccacaggcacaagaagcaagtttcagttatatggcgacaaacggtcgctgtctcttctttggcggcttgccaaaggagaaagaggaagtcaaattgaacacgaacattcttcattacaaacaattacgcgtttttggttgtactcgtgccagcttggcaggctatcgaacatccgcacagctagttgctagtggcagaattccgttgaaaaaattgattacaaaatgttacacaatcaatgagtttcctcaggcgcttgaaaatgctgtcaatgcagtaggtttgaaaaatgtcattgtctttgacgaatcattttagtttgattgcttccattttcagtttcttttataatgaaacaaaacacaaaaaggtgatagaagatggatgatcaattgtacgcagaggaaagaaaacaatcaatcgttaaaatagtcaatgagaaaaaccggatgcaagttgctgagttggcggaacttttcaatgtgacgggttcaacgatccgcaatgatttacgagaacttgagaatgaggggttagtcactcgaacccacggtggcgtgattaaacgtgaatttcaacgaagtgttgagacgatccccaaaaatcgggcctttaccaatgaaaaataccgcatcgctgaacgtgcggtccgattgatcgaagaaaatgatattttggcgattgatacaggaacatcttgccgtgcgtttgcagaaaaattgatcaacagtccactgaagcatttgacgattttgacctatgatttggagattgccttattgataagtgagaaaaccaattatcaagtgcaagtcattggcggtaccattcgaaatggctatccctatgtttcaggcagttctgtggcattgggattagcgggtttttccgtggataaagtgattctaggcaccacttcttttgacaagaattatgggcattcaactcctaattacgaaacggctgaaatgaagaaaagcctgatcaatattagtcggatcaaaattgttctatgtgaatccagcaagatcaatcagcggagtttcaagcaatttgctgcaccagatgaatgtgattatttgattacagattctcatatcacacaagagcagaaagctgaactggatggcttgcgtgtcaacttgttgattgcttaggaaaacatatctagatatctgggtaacgaattttgtgaaagagccatctaagagacaggcctgaaagggaacgaaacattccgctattcccttgagagcacgtttatgtcttagtggcctttccaaacaattcgatgattcattccagcaaaaaccacgtccgagtgtttctaggacgtggttttcttttgatcggataatttttctaaaattgtttcggcaacggcttgcggaatgcccgcttgctggatctctgccacggaagctgcttgaatgtttttaagcgatttgaaggttttcatcagctgttgcttacgttttggtcctaaaccaggaatttcatccaatcttgaagagaaactgttcttgctgcgcaattgtctgtggaaagtaatggcaaaccgatgaacttcatcttggattctttgcagcaaaaagaattcgactgaatttcgttcgagctgaatcggctgcagatcatcgccaaacagtaactcgctggttttatgtttattgtttttgacaagaccagctactggaatatctaatcctaactggttatgcaagacatcttgtgcggcgcctacttgacctttgccaccatcgatgacgatcaagtcaggaaatggcaatttctctttcaaaactcgcgagtagcgccggtagatcacttcctgcatcgagccataatcatcaccgccttgtgcggttttgattttgtattttcggtaatcatcttttgaaggcttgccgtccacaaagacgaccattgcagaaactggatcggttcccataatgtgagagttgtcaaacgcctcgatgcgataaggggccgaaatgcccatggcttcacctaatttttccaccgccccgatggttcgttcttctgtccgctcgatgagagcaaacttctgatccaatgcgatttgcgcgtttttattggctaagtcgaccaattttttcttgtcacctcgttgtggctgcaagactttcgtttttagcagcacttctagaggttcccgttcaatcgtttgggggacaaaaatttcttttgggatgaagtgctcgttcttttggtagaattgaccgatgaatgtcaaaaagtcttcttccgcttcgttgtaaaaaggaaacaaggagacttcccgctcaatcaattttccttggcggataaagaacacttggacacacatccagcctttgtccacactgtaaccgaagacgtcgcgatcaagcagatcggtcaaagtcatcttttgacgcgtcataacggtatcgatggcttggagttgatcgcgcagttccgcagcacgttcaaattcaagggattcaatcgcttcgcccattttttcctttagttctttttggatctcaacatggccaccgtggaaaaagtgtttgacttgatcaacgatttttcggtattccttgggatccatgtgatgaacgtaaggacagacgcactgtcccaaatgatagtagagacaagggcgtttttgcgatgcaccacatttgcgtaatggaaacaagcggtccaagatccgttttgtttcattcgctgctcgggcatccggataaggaccgaagtaaagcgcaccatctttcaacactttgcgggtgatgatcaatttaggatagcgttcattcgtaactttgataaatggataggacttgtcgtccttcaacataatattgtattttggtttgtttttttgaatgagattgatttctaacaaaagcgcttcagtattggattcagtgacgacatattcaaagtcggcgatctcctgaactaagcgttccgttttcgtgtcatgacttcctgtaaaataggaacgtacacgattttttaaaatcttcgccttacctacatagatgatcgtaccatttttgtctttcatcaagtaacaaccaggttgatcgggtaagagagctaatttgtttttgatctgttccttcatttcagggtcctttctaggtggtcgttcacatctgttttactttataggggaacgtcagagcccctattattctatcacaaaataattaagaaacaatgaatgagtttttttaccaaaaaaatcagttcaatcgtaagaaaagattaagaagttgcctgatggcatcaagagacaccgattattcctcctgccattgtcggataaaagaagcacaagcagcaaattctttataggaatcgcgggtccgtttgaccaaataaaattggcggcgataacgctcgcctaaatcttcatgggggacatctccagcagctcgtgcagaaatgattgaacagccgaagccttttttcaacaatgcaacgatcatctcattattggcgatttgtaaaataggcgtctggatattttgctcttctagatagcgtttcatataataataaaccccagaactttgttctcgcacaagccacggtccgactgccggatcgccagccaatactagctggtcactcatcaatgggtatcgctccacggtagcagcggataagggcttttcaatgatccctaggtcaagctcgtgttgctctaccgcatgcaggacagcgtcagagttcatcatctctacttgaaattggatgtggggaaagcgagtgtataagcgcatcagcaaatccggcagcaaatagatcgcaaaagtatgggaaacacctatccggcatggaaccaactgttgcgtaccttgttggatctcttgatagagatgctgccaatcgtccaataaattcagccctctttgataaagcaggtgagcttgtggggttgctgaaatgttcatgcggccatttcgaatgaaaagttgggtattcaattcttcttctaattgtttgatatgggcggagacggtaggttgagacacgaacagcaactcagcggctttcgagaaattctgtgtttcgtaaacgattttgaacgtttctagtttttccagcagtgtaatcacttccattataaaatcctattaaaactattatatcaataaatgttatagatgaaaaatgctgtgtataatataaggcagtatgaaaggatggacaagaatgaatgttgaaaaaatcaaacccgtcaatctgcagccatttttacctggcttgttgttatcatttattgtagcggctgtagcgaaagtcttggctctttggctgccgcaattaggaggagcgactttggcgattttattagggatcgttctaggcaatacgttcttcaatcaaaaacagtatgcgcaaggaacgaaatttgcagaaagtcggcttttagaatattcggttgtattgctaggatttactgttacctttcaaacgatcagtgagatggggattcgtggttttgttttcatcgtattgatgatgacgatcgttattactgcggcttacttgattggcaagaagttgggattcaatcaaaaaatgagtttgatgatggcaggaggcaatgcggtctgcggttcttctgcgattggcgcgattgcaccagccatccaagccgatgatgaagaaaaagggcagatcatcacactcgtcaatttgttaggaacagtgatgatgttgactttgccgtttcttggtctggcgttgtttggttcggatgttttacaaaaaagcgcactgttgggaggaacgctacaatccgtaggacaagtcgtagcgggtgccagcttacttgatgcagagattgtcaaatatgccatgctgtttaagatcgctcggatcattttattggtcgtggtggttttgattttcgaacgaatggtgtcgcaacaaaatcaatccgcatccgtcgtaaaacaaaaacgatcgttgcgtattccttggtatgttttaggttttttgctgatttgtatcttgaacagcttcgttgcattgccaagttggttgaatgatgctgcacatttcatcagtacctggtttgagaccatcgcccttgcagcaatcggcttgcgcttagacttccgtaaattcatgaaagaaggacctaagttccttttctatggactttcagtcggtttggttcaaacaattgcagcgctcagcttgatctggttgctgaaaatctaatacaggataagaaagaggctgggacagaagtgttaaactccgagaaataaggaggaatacacggaaattacttttcaaatttgggggtatttcgacttatttccgaaggagttgcttcgcctctcaccgtttagacgtgtttagagcgtggaacaaaagtgttttttacttttgttccacgctctatttttgttgaacgctctaaagcatggcttgcaaacttttttcagcgatttgttcaatcggtagtagaccgtactcttggctactaagcaaaagaatcggggtgtgtggtacggcttcttgtagttcttttaatgcaaattgagcttcaggagtcaggaggatcaaatcagcagctggcgctttttctgcgacttttgacaagctgtacatctctaccgcaatcggctgcctttgaacagtaaaatatttctgtaattttaactgcagacgttgtgtttgcagttctccctcggttatccagctgctgacactaaaaatcatgatctgtttctcagatgaggacagcttgtctgtttggatagtggacggagttgctggtactttttccatcgttttccctcttttcttttttgagaataaggaagcaaaaaaagttggttttgtattgcctaaaagagcatcggttgaaatatggaacaactgacttagcttgactaacatatccaaatccggataactgatatttcgctcccatttagaaatcgtttgcggcgtgacattcaattgattagccacctctttttgggtcatcctttttgctttgcgcaactttttgatattttctccaatctctaccatcagagtagcctcctttgattgataggtgcaagaaatgaatcgttgaatcaggaaataaagaacgcaacgattcgttgaattgctgatatattcgcatttttcgtcatttgtaaggggaactagctgattaaaatgacatgaaaaatttgtagtctaaaccgctttcttctgctatgataatcgaaaaaaggtgaaaaggaaatggtgagttcttgggttgaaggcaaagaaggagtagcggagcatctagtctatctaaacaaagaaggcaaagagctgcagaaattgttggcgggagaaaagaacgccatcatccgtggggcagcagggcgcaaatctccgttaggtggacgcgcaaaagttggcgaccgtgtctacttcgtggaaacaggtggcgatcttttagttactcatcgtggcatgattgagaacgtgattgaaacggagaaaatgacacctgaagaatcacaacaatttgttgagcagcaccaatcagaattaaatttatccaaaaaacaaatggagcgttgggcaggaaagaaatttttggccatttatcgaattgctgaactggaagcgattgaaccttttacgtatcaacgagggaagaacatggatgactgggtaatcacttctagtatagaggaaatcaaataagaaaccttaataaagcgaccacctgaaagaacagtcttttaggtagtcgcttttacttttgggatagtagcaagacttctgttaaagttcttcaccgttcgtagcgatgacccgttgataccaagcaaaggaatcttttttcaagcgttgcagacttccgttgccagcattgtctttatcaacatagatcatgccgtagcgtttctccatttctccgctgccgaaactgacgatatcgatgattccccaaggagtataacctaagacgggtacaccatcttctattactgctttctccagttgttcgatgtgctgacgtaaataagagatacggtagggatcatggatcgtgttttcttctgttaattgatcataggcaccaaagccattctctacgataaagagcggcaagtcataacgttgatagatcgtgtttaaaacatagcgaagtcctacgggatcaattggccatccccaatccgtcgcggtgatatagggattacggacgatttttgcgtgagggatatcgtcggtcggttggccttcgacagtttccaatgtcgtgatcgttcctgacatataatagctgaaaccaatataatcaacagtccctgcctttagtaaagccttctcttcctcactgatttggattttgatccctttttgctgccagtaagtttgtgcataggtcggaatctttcctctgacgtggatgtcactatagaagtaacgacgttcattggctttgaccgaagccatcaaatcttctggtgcacaggaataaggatagattgggacataagccatcatacagccgatttgaaagtctggattgatttttttcccctcaatgactgccgccgcactagcgatcagttcgttgacacccgcttgaaagaccagttcttctttcttgctttcttcttcgatgatcatggcggagtttgtccagacatgtaatagttcctgtccgtctgcttgattattgatttcattgaatgtcatccagtaggtgactttatctttgtagcgttcaaaaacgcaggttgcgaatttaacgaagaggggaatcacggctttattgacaaagccaccgtaggtttcataaatcgcataaggcatttcaaaatgagacagtgtaatgattggttcgatcccattgtttaatagttcgtcaaaaaggtcatcataatattgcaggcctgcttcattgggctcgtcctcttggccggttggaaaaatacggctccaggagatcgatgtacgcagacactttaagcctaacgctttgaataattgaatatcttctttgtagcggtgataaaagtcgatcgcttcgtgattaggataatacacatcttctttgatgcctctcgtgatttcacgaggaatcccgtttcctccagcagtcatcacatcagcaatactcatgccgcgtcctgcgacattccaagccccttctgcttgatgggcagcaattgcgccaccccatagaaaatcttttggcattttgctgctcataattctttcctcctaaaaaagttacgcttcgattttttgtgaacggtttgaagcaatcacgaatggcaagtatatcaatacggaaatcgccagacagaccacaccaacgattgcagctactgcatttccgccagttcctaggaacaagttgatgattcccggtgtggtccaaggcacaccgattgctggtgtcggcatgatcggccaaatgactgttacaaaataaccaactagaatattgaccattggagtcaatataaagggaatgatcataatcggattcaagacgatcggtaacccgaagataatcggttcgttgatctgaaagattcctggaacaagtgacatcttagcgatctcccgttgttctggtcgcttcgaggcgatgaaaatggcaatgatcagccctaacgtcattcccgttccgcccatattagcaaacatgtcgttcaaaacgccccacgtttctttgtaaggtacatcccacaaggaaccgccttgattgatgaaatccaagttggctaaatcttgttctgtaaaaattgctgaacgaacggcattcaatgtatttggtccgtgaatcccgatggagaagagcagtgtttgtaagaaagctaaaatcaagacaccaacgacatttcctcctaaatcacgcaacggactttggatccctttgtagatcaattcattgatgccctctggcgcaatcatcagtactaggaaattgatcaatgcggtaactgctacgatgatcacgataggaatcattccagaaaacgaacgggaaactgccggcggtaccatatcgggcattttgatctgtaatcgtttgactttgaatagtttcggcaagaattctcctaccagacaagcaacgatcatggcgacgaataagccttgtgcgcctaaatattgggtggagatggcattgacaccgtcaactgagaaagaagtcggatataaaatcataaacgcagctacacttgtcaaaccaactagtgtcgcatctgcatcaaagtgttttgctagcagttgggcaaccagataagcaatgaatacgctcatgatattgatggttccgttagcaacagatgccagtacttgctgggcactttctaaattgggaaagatttttgagagttgaaataattgcacgataaaactatcgttggaaaataagatattgttgaccaaaataactaatgaagaagaaatcgtcaacgggaaaatcaacataaatgcatcacgaatcgctgcgacgtgtcgctggttattcaatctggtggcaattggtaccaaggaccggtctagtagatcattaaatttttgcataacagtaacacctttctctatttgatggacttattatagcgaaaggttgcctgaaaaagtaagcgcattcgtttttagaatcaaattctgtgaggaagaaatttattccacagtcggaacaagtggttacaaaaaacagaaagcagcaagacaaacgcttgattgcagccactagtcagaaaactgctgctgtaaagcgagtgttctggctagggcgttcttcgttgtctggtactttctgtgctcgttcatcattgaggggtaggttcatcttgtaaataaccaatcagtgtttccacgatggcgatggctggaagctggctagtcagatcgaggaagatgtctttgcgctcttctttgactgcgtattcgatcgagtagtcacataaatgggcaagagaactctctttatttctcgtaatacaatatttttgggcaatcgctttattagctaatccagtaatgacttcgatcaattcttttgtttcaccagaaacactcaagaaaaccagaacgtttttttgatcggctcgtaagaagctgcggatcgggtaagtcaattcatcgatgctgatgcagaagtagccgatatttgcgagcttgcgggcgacatactgtgcaattgctccagacgcccccatccccataaataaaatacagtccgcatctcgcagtgtttgcgccatcttcttgatttggtattcgacatcgggatggaaaatcgtcatgttcaatccacggatgcgttcttcaagggataactgtttttgatgttcttcataatggactttttctaaatgggtcttgatataaaagcgaaattcaggaaaggaatcgaatcccactttttgaacaaaacgaaagacagaagtggaagaaacatgggcatcatctgcaatatcccgtactcgcatataagggattttttctaaattattgacaataaagcgatagatctcttgttcgactgaagacaatttgtttaagttcaaatgctgaaaaacggccataaatgttcctcgctatcccataagagtatatgacgagtataccatgatttagcgagtgagttgctgatgaatctgataaactgcaccaattaatccggcgtcattttgcaatttggcaggcagcacaggagcaatcgtttttccccgcaaatagttgatggcagcgtgttgtgtttcgacagttgttaatgtctgttgcagtcgttcaaagaaatatgggttggcactgataccaccgccaatcaaaatggcttctggatcgaaacagctgatcaaattgatcaacccgacggacaaatctgtcaggaactgttgggtcactgtttctgctaatgtttctcccatctgtgcgcgctgaaaaatttctcgagcatctgtcgtcgcttgaaatcctgccagctgaccgcctttttgattgtagatccgaacgagcccatcaacgacagcagctttacgattgatcgaaacttcctcactattacctgtagaaggcaaggcgtcgatcaccatccagccaaattctcctgccatgccgtgggcaccgcgatacacttgatcattgattacgatccctccgcctacaccagttcctaagacgaggcaaaggtaattggagaaggattgggcattgccgatccatttctctgcgatggcggctgcattggcatcattctcgacagaaactgttaaaccacagcattcttctaatgtggttttgaaattctcgccgtacaatggtttgatggcgccagctgtcagcatcaaaccgtctttttgcacgatgcccggcgcactgatcccaatcccggcgatcggatagcgacttttagcttcattaataattgtgattaaattttgatagaaagactggggatcgtagtttgtcggaagcatatttttttccagaattgctcctgtttcatcaagaaccccgtatttgatcgttgtgccgccaatatcaaatcctacatacatcgttattcctactttcttcttttaatcagtgtcttttctgcattgtagcatggcacttgttggaatatttttcttttcgacggccagaaacaagggtggcgtttgcgtgctaagaaaactgtcaatcaatgatttcggcttttccatcttctgttagttgctgcaggtgggataacatctgttgaatcacttcttccgaatgccgttcccatgcccctaattctgcgacgactttcagcggagaggcagaacggtaggaacgggtcggattaccagggaatcgcttatcggtcaagttcgggtcattttcaaaaggcccagtcggttcaaccaaataaattctttcttgcccagttcctttggctaattcggctccccatttggctgcatccaatgttgcggtgaagtaaatgtagtttgagatccgaccggcttcaaagttggattctttttttggttccagtaattcgcctaattgtaatgatgcttttgttccgtggaaaaaaggtcctcggtctaatgaatcgtttgtgtgctccatttggttcatcctttctatcattcattgttttacttagcatacaagaatccctccagattgaaaagctgtttgtctagtggtggaatggtcactatgtgatacaattaccagattaatgtggtaatcagatattatttactattatgcgctgattccctaatatatagttaaggaagcgcttcctggaggtggtcaaatggatttgagtaaaagagagaaagtgttgttgcaattgctgctgacacaaaaagagttcagaccagccgctttttttcaagaacagctctatgtttctttaaaaacagtctatacagatttggcgagtctggaagaaaaaatcaagccttacgggttgaccattgctcgtttgcctagaagaggggtcaagcttgaagggaatcccactgcaagggaaaaaggctacaaactcatcgttactgaaggtaaaatcgttgacgaatattctcctgaatatcgtaaattgtttatctttgcaaattatttcttctcgaaaaagccaatgcattaccaaggatttgcagaatatttctacgttagttatcagtcgatcaaaaaagatgtagatgaattattcgctttttgtcagaagaaaaaagttcgtgcgtcaatgtctgcaaaagggttgaagctagaggaggaagaatctgttcaacaagcaactttcaaatcttttcttgaaaaacatacagattctgcaagattggatcactctgccattcagacattgtttgatccgaagatcgttaccttgactacagcactgatttcagaaatatccttaacacttggtcgccaactcaatagttattttgtggaatccttgacggtatcgttggaaatttttctttcacggatttgtctaggaagacatttggaacagcaagagaatttgggatttgagaaattaaaacagatgaaactgtatatggttgctgtttcctttgcagaacggattgaaagtgaactagctgtttccctagcagagacagatatccaatacatttgttcattgcttttagctcatggaattgagccgtatatgcagattacggaaaaaagagaagccaacgtgatcgaaacaacggaagaaatgatcgagaagatgtcccgtttgctagatactgatttgacacaagataacttattgttgcaagcactgctttcgcatattgtccctatgatccatcgtctgaaaaatggcatgttagtcaaaaatcctttgttgcgattgatcaagaagcaatactcgaccatgtttacattaacgaaatatgcgattggcggactagaaaaaaactttgcactcttcttgacagaagatgaagtgtcatttctaacgattcattttcaactcgcttttgaaaaaatcaaagtcacaaagcatgtgctgatcgtttgcagctctggattagccacttctgagctgatctttaaccggatcaaacaaacgatttctgctacgacagttttagagatcatcagtgcagagaaattagccagtacatcactagaattagtggatttgatcatttcaactgttccgttggaggaagtgtcaccccctgttctctatgtttcaccattaccgacaactgaagaaattgccatgatttcggcaaatctttcaaacctgaatgaaaatgaaaagaaactgcattcatccaaataccaatcatcagagctattgcagaaatatctagatccggcatttttgtacattaaccaaccgtttaacaccaaaaaagacgtcttagattttcttgcagagagttatttgagccatcatttagtcaccaacgattttaagcagtcactttatgcacgagaagaattaggcagtaccggattaaagacaggcgtagcgattccgcatgccgatccgcagactgtcaaaacaacaaaactagcatttgttacactacctaaagccataaaatggggagatacggaagttcaattagtcgttctcttggcaatcgctgaaaaaaatatgtcagaagcaaaagaattgattgcatctatttacgatttattcaactctcctgaagaaatacgatgggtggttagcagtaaaaatcgagaagaactttatcgtaaacttgtaaaaggagggaccccgaatgttttttgaccagcaaattgctttattaaacaaagaagtagaatctaaagaagcagcatttcggctacttacagaggaatttttaaagaatgaatgtgtgacagaggcgtatcttgacaacgtgattaaaagagaggcggtttttccaaccggtctgatgatcaatgggattggcgtggcgattcctcatacagatagtcagtatgtcaagagatcgcaagttggctttctttcattgacagatccattgccattcattgaaatgggaacaagggacaaagaaatttcagtttcattaatctttatgttggcattaaaggagccgcacgaacaattacaaatgctgcaaaacttgatcgaaatgtttcaaaaaaatggtgtgttggaaaagttaagagacatccatgatgttgaggaatatcggatgattttgcaacagtatggattggaataaggagggaatatcatgttaaatgcgttacagtggtttgttgatttagggtcaatcgttgtactcccgattttgatatttatttttggtcttattctgggaacgaaaccaggcaaggctttcacatctgctttaacagttggtgtcggttttgtgggcttgaatctagtgatcgacctgttaagcaatagcttaggaccagcagcgcaacagatggttgagcgatttggcttgaatctgacgacgattgatgttggctggccggcagcagctgcgatttcctatgggacgattctaggaagtctggcaattccgatcggtgttgtgttaaatgttgttttgattatttttggcctgacgaaaacattgaatgtcgatatctggaatatttggcatgcggcgttcatttcttcgttggtctatgctttgactggcaactttgccatggggatcgctgcaaccgtcatctatctaatgatgattcttttgatgggagatattttaggaccgatcattaataaattctatggtttcccgaatatcactttcccacacgggaccgctgctccaggatttgttttcgctttaccgatgaactggttattcgatcgtattccgggattgcgagactggaaagctgacccggaatcgattcaaaaacgttttggtgtctttggggactcgacagttatgggctttctgattggtttgatcatcggaattctcgctggctatgatgtggcaggcactggccaattagcagttaaaaccggcgcagtgatggtcattatgccaaaaatggttgctctattaatggaagggcttacacctatatctgagtctgccaatgactttgtgaagaaacgtttccctggaagagagctttacattgggatggatgcggcgctttctgtcggacatccagcagtattgtcttcgtcattattactcgtaccaattacgatacttttagcggttgttttgccaggaaatacgacattgccttttggagatttagcaacgattccgtttcttgtctgtttgatggcagcagtatttggcggaaatattatccggacggttatcgcagggacaatttatatgaccagtattttgtatatcacttcttgggtcgcaccattagtaacaacagctgctaagtctgccaattttgacttacaaggaaattcaacgatcacagctctagctgaaggcggactatggactacctggctttatgtcggtttgacaaaagtattgagctggggcggattagcgatcatcggtgcgattgttgtcatcggtttgatctatgttaacaaggtgttacctaaaaaacaaagcgtcatgtaggaggaagaacaatgaaaaaattattgatcatgtgtggaaccggagtagcgacatcaacgatcgtaaccaataaagtcaaagaatggctaaaagaaaaagaactgacgaatgaagtcaaattgtatcaatccaaagtcgcggatgaaatgaacaagatcgacgattacgacattgttgtgagtaccacggtagtccctgattccatcaaagacaaagtcatcatgggattgcctttattgacagggatcggtatcgaagaaatgtatgcagaaatcgaaaagaaaatcagagaataaaggagtcttgcaaaatgcttgttaccacaaaagaaatgtttgaccatgcagaggaattcaactatgccattcccgcagccaacttttttgatctagacagtgcccgcacctatgttgaaacggctgctaggctagggtgtccattgatcttggcttttgcccaatcacatatggatatgctgagtttggaagaagcagccctgattgggaagtatttggctgaaaaaagcgccttccccgtagcgttgcatttggatcatggtcaagatgaggaagtcatcaaggaagcgattcgtttaggcttcacttctgtcatgatcgatgcgtcagaagacccgcttgaagaaaatatccgccgctccaaagcgatcgccgattatgcccatcaatatggggtggtcgtagaggcagaaattgggtatgtcggctctggcggcagtttggaagcaacggggctttctgattcgatttataccgacttccatgaagcagtaagatttgctgaacaaacgaatgttgattcgttagccgtttcgatcggcacagcccatgggcattaccgaggaacgcctaaaatcaactttgatgtactaagtgagatccatcaagccattactattccgttagtcttacatggcggttcttcttctggtgatgaaaatcttgaaaaatgtgcacaaggcgggatccgaaaaatcaacatctttacagatttcgttacagccgcaatgaccaagattcaagaacagcagcctgctgactactttgaactaaagaaagcagcgaatcaaggaatggcagatacgctagcacattactatcacgtttttcatacaaaaacttgttaggaggataagcatgaggaaaaagcagttacgagcacccttttttgtagtcaatcccaaagcctatttatacggaaaagaatccttggcactggcaaaagccgccgatcaattagcggaaaaatatgacgttgatatcttgttcacggtgcagcacgcagatgccgcaacgatcaaacaagctacgaatcatttgttcattacggttcaacacatcgatggcatgactgttggacggggaatgggctacgtcttacctgaatcagtagcaaatgtcggcgtagcagcgacatttctcaatcatgcagaacacccaatgacattagatgaactcgcaaaagcgattaatcgggcagatgagttggggctcatcacgattgcttgcgcgaattcactgcaagaagctaaagcagtggcagctctgcagcctgacattatggtttgtgaaccaactgaattgattggtaccggtcaaacgagtgacgtttcttatatggaagaaaccaatcaagccatccgtgccatcaacaaagaaatcaagattttacaagcggctggtatttcgaccgcagacgatgtggcaaaagcactgcaatcaggagccgacggaacgggtggcaccagtggtatcgtctgcgcgccagatccgcagaacgttttgacagaaatgatcaaaaaagttgctgagctaagagatgaggggattaaaagatgaaattcgcgaaagaacagctaacattgacatcaaatggcaatcgggtatcttatcataatattacgcaagaagtgaaggactttgtagagagaagccaaatcaaaaacggcatctgtttagtccaatccccacacacaacttgttccgtcattttcgaggaattcatgcatgatacggattttaatggggatgaatttttacaagttgatctgaatcgcattttggataaactagtgcctagagaactctcggaaaatacaaattatcgttaccctggaccgaaacatttggaatttctgatgagcctagatgatcctaactatccgacagatccagcaacgattttaaatggcgatgcccatatccgttcttcgtttttcggggcgagtgaaagttttattttacatgaaggaaagcttgaaattggttctgtagggtatatttatttcgtggattttgaccaaaaccgagttaggaatcgaacctgccatcttatgttgatgggtgaataaagcaactgctagtggcaactggggcagcagtattctgcaaggacatgggaaaagtcgaacgcttgagccgaaatgcgttataatcaatgagacaatgaaatttatggagggatcaatttgattattcgcccaatgacagctagtgattgtcgatcaatcgatcaagcgtttcttgcacaacaatggcctagtcgtcaagctacattagagagatatcttcaagaacagagccgcggactgcgacaggtctttgtcgcggaagactcgggacagattgcaggctatgcgacattgattccccacgcaaaagccggtccttttaaaaagaatggctatccggagatcaccgatctaaatgtctttcaaaactttcagcggcaaggaatcggcgctaagctgctccaagctgcagaagaacaagccaaaacattttcgtctgtgatcaccattggtgtggggcttcattctggttatggcactgcacagcgactgtatttaaaaaatggctacttacctgacggatcaggggtctggtttgagaatcaagtcttggcaatgggtgctgcttgttacaataatgacgatcttgtgctttatctttctaagtccttttgacaagcaaccagcgtgttatttctatctaacaggtataatctacagaaaatacgatgaacgtcaatgctaggagcatactagccttgacgtttttttctacgaccaaacaagcttcgacgtatctcggtcctgctagatattttaggaagaatggtatgacccgcatatttgttcgccaaaaacagcgttcttttctttgattagaaaggaagaacgctgtctagattctgttccatattcaaaaaaatcagtaacacttctcgcagggggtcaatcctttgcttaaagcttcggacaacgtagctgggaaataagtaccattgccgcatttatgggtgtgatacttcttccctgtacgggtgatcatgacatattcttctgcttgattgcttgtggtttgatttgactggctggcttggtttgcctgctgtttcgcagcggcggctgcttgccgttcttgttcggctttagcaagctgccgttcttgttcttcacgaatcgattggcgaacagcttcagctcgctgcgtcaatccatcatctgctgagggaagcttggcaatcgcagaagttgcactagctaagtttgcttcagtcggctctgcttcggctttttcaacagctttggtcgcttgtgcttgcaatttcgcttgtgtttctttctcttcaacttttgtttgtaaagaagccagtcgatcttcaaattcagttttcgtcgaacttgttgctgcaacaagcttggcagctgcctcaaggtctgttctgcttagactttgttccgctttttctaacgcgctggcgatctgcagatgatcttggaggacggccaaacgttgatcataatcgtcatatgttttgctgagagaatgaaccaatgttgctgcttcatcataatttttttgtgttggtttagattctgccaacgctagtgcagtttcgacctgtttaatcagttctttctccgctttttctgcttctaaataagccacaaattctttggaaggtttgatcaagacttcctgttcttttttctgatcatttaaggcagcttttaccacaacttgttgctcagtggcatcattcaggtgaactgtgtagctaaaagaacctttactgtttttgaccgtttccccattgatcgttaggacagcatcggccgtggcttccccttcgatagtcgcttttcctgtttcatccgtttgtatttcaggtgaaataacagatagtgtcaaattgctcggagataaaattgcaccagcaaaaaatagaataacgcttccgcataaaataaatcccaatctttttttcggtcgcttcttgatggcagcgataatcaacaaaataccgcttacaattactgctaagaaactgaccaaactaatccacatacccataacttttctagttcctttcactttttgatgtctttattataacatgatttatattaaaaacatgaaaaaaataagaaaataaaactagataataacaatttgtttttacgaatcgttcttatttatagaatcctttttagggagcgctagaaaacggttccttttaattgctatttttttaatacagatgaaaatagtgtattattcttgataaataaaagaaaagtgctattattagtcgtgagattaatacagattttgaaaagaggtagtacagtgagtaaaaaaggttcagaaattattgttgaaagtttagaaaatcatcacgtcccctatatttttgggattccaggagcaaaaatcgatggtgtcttcgatacattagaagaccatggaccacaattgatcttagcccggcatgaacagaatgctgcatttatggcacaagccattggccgtttgactggagagccaggagtagtcattgctaccagtggtccaggtgccagtaatttagcaacgggattagtgacagcgacagctgaaggagatccagttctggcattggctgggcaagtgaaacgttctgatttatcgaaactgacccatcaaagtatgaacaacgctgctctctttagtccaataaccaaatacagcacggagatccaagatcccgaaacattatctgaaaatatcgcaaatgcatttcgaatcgctaaaaccgcaaaaaaaggtgccagttttctgtcgataccacaagatgtaacggatggccaagtcgaaggaagtgccatcaagccattatcagcgccaaaattaggacaagcgaatccagaggatatcgaggatctcgttgaacgcatcaaggaagcaaaactaccggttttattactaggcatgcgggcttctgctgaaagcgagacggaagccattcgtcatttgatagcgaaaacgggattaccagtcgtggaaacttttcaaggagcaggaatcatttctcgtgctttggaagaccatttctttggccgtgtgggcttgttccgtaatcagccaggagacatgctgctaaaacgaagtgatttagtgatcgctgtggggtatgatccgattgaatatgaagcgcgcaattggaatgcagagaaagacgcacggattattgtgattgatgaagtaccgatggaaatcgatccatacatgcagcctgaagtagagctgttaggcagcattgccaaaatcattgagcaagtgacacaagccatcgatcaatatacgttatcagcagatgcacagaactatttagctacgttgcaagaaaaattaaccgaaaagcaaatagaggcccgtggaacagaacaaacattgcatccattggagatcattgatacattgcagcaaaaagtgacggatgagatgaccgtgactgttgatgtcggcagtcactacatttggatggcgcgtcatttccgcagttatgaacctcgccatctattgtttagtaatgggatgcagacattaggtgtggcattgccatggggaattgcggcagcattagtgcggccgaatacgcaaattatttccgtatctggtgatggtggtttcttattctcttcacaagaattagaaacggctgttcgcttaaaacagaacatcattcatcttatctggaatgatggcacctacaatatggtgaaatttcaggaagaaatgaaatatgatcgtgcttcaggtgttcaatttggtcctgtagactttgtcaaatacgcggaagcctttggggcaaaaggattacgtgccacaacaaaacaagaattgacagccgcgatcgaagaagggtttgcaactgatggaccagtcgtcattgatatcccggtcgattattccgataatgccgaattaggcaagacgattttgccggatcaattttactaagagtatttattttactaatagaaggagcttcatgatgaacgtgaaaagcaaaagttatttatatcaacacggaactttaggcgggttgatggaagatttgatggatggtaccgaacaaatcggcaagatgttagcctatggtgatacaggaatcggtacattagctggttcaaatggtgagattattttcttggagggtgtgatttatcatgttgacgaaacaggacaggtgaagcagctgacagggaccgagacgacgccgtatgcagctgtcgttgattttgaagccacggatgaacttgcttttgacacagaagctacagatgaagaagtcaagggaagactattagcgaccatcagtcccaatttgtttgcggccatcaagcttcatggaatgtttgatacgatgcacgtgcgggtagcgcctaaacaagaaaagccctatccaaaattcgttgaaatcattcaaaatcaacctgaatttacggcgacagaaatagcaggaactatcgtaggcttctttaccccgaaacttttccatggtgctgcagcagcaggcttccatctgcactttattagtgacgatcatcagtttgctggtcatgtactggattttagcttaatcagtggtgaagcagaagtaatggaagtagccgagtttcgtcaacattttcccatagagaatgctgagttcttgcagcgggaaatcgacgtgaaaaaaattgcccgggatatcgaagaagcggaatgattttttactatagttaggtagattttgcgttgcatttgattcttcactgttggattattttctgaaaaaaagtatctgaaatacagattagaaggttaggaagtaaataggagaaaagtgcagatttcattgctgatttccgacttcactctgtatcagatgcttttttagtattgaatagatttcctgcagctgtacattcgcccaaggggaagaattgtagttctcggatggatcaaaaagatgtgcgccatagaatgcaaaaataaatttcagataagtcgaacaatttggcctgtttttcctatacaatagaaagtgaaagggctttttttgagaaggtaattccattaagggccgctgtccacgaaacgaatgagaaagagggaagacacatgaaagttatcatcacggaagattatcaagagatgagccaagtagccgtacagcaccttttaggcgtaatgcacagccagcatcgaaagaatatttcaatcaccgctggatcaacaccaaaaggggtgtatgaaatgctggtaccactagtaaaaaataaaaaatattttgagcacgttcacttttataactttgatgagattccattcaaaggggaagaagaccgctatggtgtcacgatgacgaacttgcacaacctgttttttggaccagcggaaatcgatcgtgaaagaatccatgtcttggactggacgaattatgaaacacaagatgaacgaatcaaagccgatggtggattggatatggtgttgctgggggttggatcagatggccatttctgtgggaatttaccgaacacgacaaaatttggagatttaacgagtcgcgtgaatgcgaatgcgacacccgagatggctgacgttttgttaagtgaggttggtggagacaaagaaaaacaacctgatttctatgtaacaatgggaccaaaaagcatcatgcaggtgaagaaattggtaatgatcgccaatggcaagaaaaaagcaggcatcgtcaaacaattagtagatggaacagtaatggaggacgttccggcaacgctattgacgacccatccagatatgacattgatcgttgataaagaggctgcctcgctgctttcatactaaccagcggaatttgatttttctctatatcttaatgaagtagttcctagtagattggacaataaacacctgctacaaatagaagtcaatccccctcttaccattagatcctttttgcttaaaaggattctaatggtaagggggtttttgttgtacgttgacaaagcttgtttcagaaggaaagcagattgttttacaacttacaaaaagtaagttattattatctcgaattcgaaataaatcgagcgaggtgaggaaatggatcatcaagaggaagcattgaaggtctatattggtttattacgcagcagcagtcacttagagcaggtggctaaacaagatgtccgctgttatggcttgaatctgacagagttttccgttctggaactgctttatcataaaggtacacacaccacccaagccatcaaagaaaaaatcttgattgccagcagcagcacgacgtacgtcatcgatcaactcgtaaaaaaaggctgcgttcgtcgagaaacaagtcaaacggatcagcgaatcacctatgtcagtctgacagataaaggggcagaattgatggatcagatctttccaactcatgccacaaaaattgcggcaagttttgcctcgcttagtattgacgagttgcaaacattaaaaacattattacgaaaaataacttataacgagaaatgaggaagaaaaaatgagaaaacaagaccaattactaggggtacaccatgtaacagccatgaccagtgatgtcgaaagaaactatcacttctttacagagattttggggatgcgtttagtgaagaaaaccgtcaatcaagatgatatttatacctaccacacatattttgcggatgatctaggttccccaggaaccacgatgacattctttgattttcccaataccgatcgtggcagtaaaggaacaaattcaattacccgtacaggctttcgcgtaccatccgatgctgcattagactattataaaaagcgttttgagacatttgatgtgaaacatgaagcgatcacaacagaatttggcaaaaaagtgttgcgcttctgggattttgatcagcaatcttaccaattgatttctgatgaacacaatcaaggcgtcaaagcaggtattccatggaaacaagggccagttccagaagaattcgctatttatggtttaggcccagtcgaaatctccgtttcttattttgccgatttcaagggattactggaaaatgtctttggattcaaagccatcgatcaagaaggaaatcgcacgctattagaagttggcgaggggggcaatggggcagaaatcgtcttagtcgaagataccacaagcccacaagcacaacaaggagacggggaagtgcatcacgtcgcctttcgtttagccgatcgccaatctttagccgtatggcaagaagtttttgaaaatttgggtctcgcgaattccggctatgtggaccgctactattttgaatcgctgtatgtacgtgtaggacatattctttttgaattagcgacagatgaacctggcttcatgggtgacgagccttacgaaacattgggcgaaaaattatcactggctccgtttttggaagaccaacgtgcaatgatcgaaaaagcgatcaagccgtttgataccactcgcagccataactaaggaggtaaaaatgatgcaacccattcaacaaatccaccatatatccgcaatcgtcggtgacccgcaagaaaatgtagacttctaccgcgaagtattaggcttgcgtttagtcaaacaaaccgtcaactttgatgatccttatacgtatcatctctactacagcaatctgtccattgaaaatggcacgatcattacctttttcccatgggccaacgcgcatcctggtcgtgtcggtagcggacaggtgggcacgattacctttcgcattcctaaaggcagcagcgactattggaaacaacaattggcccatcatcaagtcactgttcatgagagccatctatttgggcaaccaacattggaacttcaagatcctcatgaactgtctttagcgctagtggaaggggaagcagcggaaacaaacgcgattcttgggttccatggagcggtcttactttccgctaagccagaggaaacattcaagacgttgacccatgatctagggctgcaagttgtagcggagacagaatcaaaccgacgattggtgactgccggaccagtgaaacacgagattctcctaccaacagagccactgagacctggtcgttggggtgtcggtaccgtccatcatattgcctggtcggtaccgaatgaggaaagccaaatcaactggcaagatgacctttatacaaaagggtatggtgttacagaaatcaaagatcgtaactacttcaaagccgtctattttaaagagcctggtacgatcctttttgagattgcaacggaatctccgggatttctcatcgatgaaccattggaaaccctggggacagcactcaaattgccccctcactttgaagagcgccgcggagaaatcacagctcatttacccaaattgactgtttaatttacaagtaggaagtcatcaatcatacacaaaaaagagaaagcggtgttgcatgatttatttggatccccaaaatctgacgcaaagagaaaattataaattattgatcggctcgatcattccgcggccggttgccatcgtaacgacacgatcggcagaagggaccgtaaacattgcccccttcagtttcttttcgatcgtcagttcagaacccgccatcgtttcgatcgctgttcagcgaaaaaagggcacgatgaaagatacggctcgtaacttactcacgaccaaggaagcagtgatccatatcttggatcgcagcaatgtggaagcagccaatcaggcagcggcactgttacctgcagaacaaagtgaattgaccgtcgcaaattttacgccagtcccttctcaaacggttggcgtacccggattgcaagaggcgaaaattcgctttgaaaccaccctttaccaacatgtaccgattaacgaggaagaaaccaaggaaaaaaacaaagaagagataaaagtggatctgctcttacttaaaatcactgggtatcaaataaatgaacaggtctatgaagaaggaaaaatcaatcccaaaaaattggcggcagttagccgacttgcgggaaattcgtatgctgagatcggcgagatcttcgatttggcacgaccaaacgagaaggaggacaaatgaactttatctttcaccaaggaaaaccagctgctcccgtacttgtcttgttacatggaaccggcggcgatgaacgctctttgcttgatctaggtcacgacctagatccccaagcatcattgctaggtattcgaggcaatgttttagagaatggcatgccccgctatttcaaacgattagcagaaggcatctatgatgaagaagatttaatgttccgggggcaagaactggcagcattcattcaagaagtcgctaaagaaaaaggtttctcaatcgaacaagttgtcttggttggttactctaatggagccaatattgcgctcaatctattgctggaattcagtgctctttttcaaaaagcgattttgtaccatccaatgtatccagtatcgaaattacccaatcacctactggcacaaacaaacgtatttatgagttttggtctgaaggaccctatcgtttctgtggaagacagcaagtatgtgcaagcgatttttgagtctcgaggtgcacaaatagaatatgtttggaccccaagtcatcaactgacctatcaagaggttgaaaaatcacgaaagtggttagaaaaggcagattaactggttgtgaaacagggtttaacactatatatactgtaaaaaaacacaactgaagacaacaatttaaaaaaacagcaaccaaaggggcagacaagatccagtggctgctgtttttttatagaaaaagtttagaaattcaggtagcgtttactgctgcttatttttatgccatactattgattaataggcaaaccaatttattaaatagactttctattgaggtcatagaagaagtgagaatgctctgcaaaagtatctgaaataatcgaacgaggttcttcttggatgtgccctcgtgagagagacaactgataaaaataaaggagaaaagaattggcaatttcattaagaaaagcaacaatagatgatagcccactgatccagaaatggtggcaagacggaaaggtgatggcagcggtcggtttccctcaagggttagcagtgagcattgaggaagtacagcaatcgcttcattactacgaggaggtttctggtgagtttttattgattatagacgaaaaaggccacctcattggagaatttgcctacaagcctatcgaagctaaaggagcaacgtttgatataaagattggtgaactgtcaaggcaaaggcaaggctatgggaaagcggctttagaaaaaggcatgcaaaggattgctgcccaaaatcgctttaatcgaatcgaaatcactgtcaattctacaaatgagccggcactgaaattatacgaaaaagtagggttcaaacaaagcggttttttgaaagatcattgggtgaatcaagtcggtgagcgttgttcgacagtcgtgatggtatatgaattagcagatgctgacaatggcctgaataaaagtaattaaggcactaaatcatattgcttattaaagaggtctatctggataaaaatcgcagatagcgcaaaaatagatttccagcaggatactgattaaagtcatcggttacaagagtctttcataatcaatatcttgatgatatccatcgttttagttcattctcctctttttttgaactggctagttagagcaatgctctaactattaggacatttgtttgagcgaagtcaaggcatatgaataaattcgctgttgtagagataacaacctatgtgcgaaaggtattggtcaactcctaagttaaaacgtataataaagaaaaacaatataggagcgtatatcatgaatttaataggaattgatttggatggaacactactaaactcggagcaaaagatcagtcataaaaatgccgcttctttaaagtcgctttccagtgattgattccctttatttgttcgggtcgagaagtaggagatattcaggcgatcctcaaagaagctgatttagcgatcccggcggtcggattgaatggtgccattgggtacgatcaagacaagctgatttttgattttccatttgatccccaagctgtaaaagaagtgagccagatcgtttcagcgtttccaacaaaaatatataccaatcaaggcagctatgaatcgcaaaactatcaagaagagatgaaaaacattttctatgcgattggtcaagaatttcctgtagaagaactgaattatgaacttgattatgaaaataccattcagtcgacagcttacgatgcgattgaagaaatcatcaatcaaaaaaatattaatgtttataaactgtttgttttcgtccctaatcgtgagataaaaaaagagctatttccgcagatagaaaatataccaaatgtctctgttactgaatcagcggccgtcaatcttgaaatcgttcctcgctccgtatccaagggctttgtttttgatcatcttagccgcatttatgaattagaccagccaacaaaattcgctattggagatagtttaaatgacttagaaatgtttaagaacgcggatataagttttgccatggcaaacggtcatccagcaatcaaagaattagcagatcatgtgaccgtttcaaatgacgaagatggtgtttcgcaagcgttagcaatgattaaaggtacaagataagcatgctgtttggagaaggcacagcctgcatttcgccctaaaagtccctgccactatgttgtcgcttgagagacaacatagtggcagggactgcttgttaacgaaaggggactatttcatcagatggttttataattcgtgaatggcctcagcaattggtgtttctccgctgatgacttcaaattctttgccaatactgttttcattttccaaaacagcgatcaatgtggcagcaacatctgcccgcggaatcgagccgaactcattgcgtttgcctgctttgacgttgcctgttcccggatcgtctgtcaaaccgccgggatggacgatggtccagtccaagttggtgcggcttctcaaccattcatccgcataatatttggcgatcgtgtaaggctgcaaactattttgtttcaacagttcttcccgatcatttctgaaagtgctgaccatgacgaaacgtttgacgcccgctttctttgccgcttccatggctttgacggcaccatctagatcgactgctatcgttttttctagtcctttgccgccggcaccagcactgaaaacaatagcgtcaacttcgtttgctgcttctgcgatcgtttcgatcgagctggaagccaaatccagtagtaccgtctcgatccctttctcttcaaagaaaggaacttgttcaggatttcggatcaaggctttttccttgatctgtggatgattcttcagttgctcggcgaaatgctgaccgactttgccatatgcaccaataaataagactttcatagagattctccttttcagaaaagggatgactgtaagtattttaataaacggaagatctgaatactaagagacaggcttctgtgatctcatagattctgatcacagctttatgaaaagtattcgaccgctcctccaactcagatcatttcgttggatgtttacttagatcatagccctttgttattggttttctcttcagagattgaagggaatttttttagctaaacttatatcgatagatgattgatcaaaaatctttctagattaagcatagcatccctcctactattcgacaaacaatgacaactagttctttgtcctccaaaacaataatgactgactatccagttgcctgtaccaactagtactggctaaaccatttccttaagctagctagtgacctgtcattcctctttagtgttataagcaagccatcaaataatcattatttagctagtattggtgattgatcaaataaacgtaaggagaaaagaaatggcttacgaagtggattttaaaaatgtagtgacggatggattagagagctctcctgttgcagaaaaattagccggtctgcgggcaaatgaagcgcgttacttttggaacaaatacaaatatgtgtataccacctatccagctgctgagaagcctgatttggtggcactgatcaagcagatcttaaaagaagaacgggatctagtttttgaatcacccattcttgaagtagcactttacgaagatgacgatcttttttggcctgaattctattatgagagtggcatggtccttaatttactctatgaaaaacatggaaccagtgaaggaaagcctccgaaacgtgcagttggtatcaaactgtcggaagggatgccggttcctgctgagctagaagggaaatttaaattcgctcgtcagcgttcgaaacttgctggcgagattcgcggctcattttttgttgtaaagcaagaatggctgtaaactgttgaaaggcgttaaaacctgctgcattctttttttgaaggatgtaatgtgttttaacgtcttttctttgcttatcttccagtgtagaagttcagacttatggtggacaatattttttctctgctgtgatatatttaggctgaaaaaataagtggctaccagtttatggaggataggatgggaaaaagagtgagttatccagcattggatagaatgaaatatgcaggggctatcatggttattatgattcattgtgatacccttattcctcaagcggagaccaatttttttatcaaaaatattatttgtcgtattgcggtgcctttcttttttgttagcagttcatttttcatccgtaaggggatgcagatgagaccggaatatttaaaagaatatttcctgcatttaatcaactcttacgtcgtatggagcattcttttccttccgatggggctagactggattcatcaaaatcaagaagtgccaatagaactacttcctgcggctttgtttgttggatttgtccatatcggcacctattatcatttatggtacatccctgcatttatcctttcggtcatttttatagtaaatttgttgaaacgtttttcgtatcaaaaagtgtttgtcatttcactagttctttatttatttggaagtttggagacctactatggtcttctaccatctggttggtttaaagatttttttgatctggttattaggctaacatttacgactagaaatggtctgttctttggcatgattttcacgcttattggctttttcatctatgatcatcaggaaaagctatcccgaatgggaaaacatagttctagttttcttttgttatttggaagtttgttcgtgttggaaggtctgttcctttctcacattcacagattggacatgaattttatcttgatgcttgtgccgttgagttttttcttatttctttggctgctctcaaaaaatccaacgcagaactcctgcttaaaaaaattacgagaactgtcacaatattattattttatccatcctatttgcattgttctggtggaagagactggtaaagcattgaagctaagcatgctctcttccggaatattgagcttcctaaccattctattcctaacccatgtatttgctaaggtcattatccacattcgcagcaaaccgttaagacctgctttgttgttaaaaactctgtttgccagtatcggactaacccttattttagctggatccttgtatcagttcaaagtgagcagcgctgtgattaagtttgaattcgttccctgtatatgggtcatttctagtttcttttcactcttcttttttatgaattggcgaatggttcttcctgcagtcaagaactaagggtgttgtcttgtctgctcctcggatcattccttattgagagaaagagccgacaggagaaactttatgagctatttagcagatacagcttgatggggtattacttagtctcacgcccgagagtaagttgtctgcagctttttgaaagccaactttttattcaagcgccaaaacatgtgtcggtctttttttagaaaaaaattatgaaaaaaaattcgagaaatctgggaatctatcatagacttttcatatttgacaggttaactttttcggactgcgactcctcttttgagatagaatcacgggtcattcttttgttaataggttaagtgagaaatacgagagaaaaatctctcatttttatcactgcttcatagaatgagaacggttgaaaaagcccggtttgcttgctattctattttgtaaatcgatagaggagggctgacaatgacgtcgttacaagagaatccttttttgactcgtcaggattaccaagcggcacttgaacaaatcatgcaaccgttgcgggcagctattttgtccactgatcgtccaggattgaatttaggtagcagcggtgctgtatatgatcagaagcgtgcagagatggaagcgcttgtacgtccgctatgggggatcgcaccttattggacagcatgccaagatgatccgttgcgagatgcctatgttgctaaattaatgacaggaaccgaccctggcagcgaaaattattggggagagatcacggactatgaccaatatattgttgaagcagcggcattggcattaacacttttactacataaagaatatgtttgggagcaattgcctgaaaggaatcaacaagcactgaaaaagtggttgtcacacgcattaacctgtaagattcccaaaaacaattggacattctttaaagtgttgatccgggtggcattgtatcagtgtggggatccattggcaaaaaacgaacttacacaagaattagcgttgatcgattcgatgtatattggtgatggatggtacgtagatggaaaagtaacgcaacgcgattattatgttgcttttgcctttcattattacggtttgatctatgctacttttatgaaagaagaagatccagaatggtcagagcgatttattgagcgggctactttatttgcgcaagattttatttactactttgatgaagatggtgaagctttgccttatgggcggagtcagatttatcgttttgctcaaaagaaccctcctttcttctgaaaattgctaaaaaacatattagctcttttgattttctttcattttattaagaatagtatacaaaattaatttttatttaaaaagcagaagttgaacatgtaaagtaatacgactaatctcagacgatgatatgataactgtttctctatagtatcttttcttcagtaaaagaacttcaaaagcaaaaaagaaccgtgaatcccttagtatcaaaggattcacggtttcttttattattcccactccatgcggttaacgttttgtaaggattaatttgttgagtttatacggttttgtgttgtttgaaaatggtagaaatcgtaacgttttttctgtattggttgcaaagaggttgcaaataaaaaaaaattgaacaaatcacttgaaaattatttcaaacatgatattatatttgtgttaacactaaaaacactttttagataagcagaggaggcaactcatggaatttgaacaaatcacttttagcaattatctagcttcgccactcgaaccattgagctttgaagaaatggaagacattcacgaacaagttttatctaatgccgacacaaaaaatgaagatttcaaagaattttgggaagaaactattcgttctgtgattgcttattcctctattcgtgcaaagtggaatttaatgactaaaaacgaaaaaatggagaaagacaattctcgaacttcagcacatgaccttgtgattaacaacttcattgttttagaacgtatttttaaaatgaatgattgggatagtaaaacatggacggaaaaattatttcttcaaagtgataatcctactagaaataaagatgacttgcaatcagtacgcaaaagaattggtgattttgcaaattatttagcttttgtttatgctttaaatggtcgataaattaaggaagtaaggtaataataatgacaaatataaaaatacttgaatggaatattaatcaacgttctagtgaagatagcaaatttcccaattatgttatctcggaaatttctcaaaaaaatccagacgttatagtgttagttgaatttaaaggaaaagaaaataagtttagattagataactctttttctgaagattattttacatattcttataacggttcaaagtataccaataataagaatgatgttaaaagaggcaacgggatttatatcgctttaaagaaaagtatatttaatgagtcttctctggaagatgtatcttgggaagaagattttgaaaataatcaacccaattggcttaaaataaaaagctcaataaaaactgggcaagaattaacgattattggtacgagaataagagttggctcaaaaaaaagaaaagatgaattgatcagtagaaaatctcaaatcaattggttactaaaagaaaacaaacatttcaataatcaaattattattggcgatttaaactatagtccctcggaggtcgattggtgcaaaaaggaagaactaaattggcaagatattatttatatgatgagagatgaaaaatacctaaactgtaaccaatattctccgtattcaccttttggaacaagttggaaatggaaacgattagactggatgattagcaaaggggtatcaattgattataattctaaatataatcaacttgattggagttttgggaaaaataataattcatcataccttgaaggatatatggttccagaaggatatttcattattaatgaacctccctatccagaccatgcaatatttacgactgaaatcattttataggggactgattaatcatggcaagagtatataaaactattcgtctagcttatgaggcgaaaatttggatagatcaattaattttgcgtagagaacgtgaattaaaagaagaaataaaaaacggtctaacggacaaactagaaacagatatgcaagaacattacggtgatttacttgacggtatctcatttaacgtagtgttaaaagtatcggctggtagtgtgatagaacaggcatatagattctgtaaaaaacgaaatttcactgatgatgaatgggaaaaaattcaaaatcgcatggacagaacggccgttaaagaaaattttcaaaatgaggataccgttacccctagaatatttttagatgagaatgtcttagagggattagaagaatatcgttatcactttaaaagtgatgaacctggcaaacgtctcccaagattgagttatatcatcaagctagttgtcttcgccttttatagtcgattagaggactaaaatttttttctaaatagtttaaccgctatttagaattttttaactaaacattgtgtatatgtggtaacactttataaaataatttgaagaggctatcatgaccaattcagaaaaagcaaacattattctacaagaaatcaaatattacttgcaattagacacactacaacgtgaatacgctgaaaaaggcatactcaaagcattatcaaaaattgaaaggattgaaaaaaatgaactatgataattttcgtttctacttcttcttagcccttggacttgggctaggactagccacaacaaaagtaactggcttaatgttcggtttactagcagtagtctgttccctatcattatttatctctatgttctttctaacaaaaatgaaacttcaaagtctttacggctggttacaatcaatctgggataaattacgaggctactaacatgatgaccattcttaataggggttcgccctattgcattatctactcaccgtcacttataacgttaaacatgaaaggaaatacctgaaatggcaattaaaccaattatcgatccaatcgcaaccgctggcaagtcacttcttcttgtggatttgaaacccgcttatgaacgtgtaaaaaattctagtggtgaatttgaaaagacggataaaatcacacactacaattacactgttgtttgtcttgaaaagaaatttgaaaaaatcactgtcaaaattgaagagcctcgtccgttatttgacactgataatgatgaaattccagatgaaacttatgtgaagtttgaaaatctgtctttcaatccgtatgtttcaaatggttggattcaattatcttctaaagctgacaaatgcgtattagttaaggcgtaacctatgaaaaacaaacaaaacaaatttcaaaaagtttcggcattctcacctagtgtaccgctgaaatatcggtggaattcattactattcgtactttttgctgaaatgggaagtgtgatttggctagaaagtcatattcaaaatggattcttgttcattctcgtgcttatcggtttgttttgcttgctgatttacacaacttataaattcgtaatcaatcgaaaacgggggtgggtgacttccccctataagttgttaaggcggttcatcatggataacaacctatttgaaagtggctaccgcataatcggtcaagataacaatggaaatgataggaagaaaaacgtcgtcattgatagcgtgtacctactctatctaaatacacccgaaaaacttgtgattcgctttttgaaaaatggtgaccaatggaatgaccttgccaatacttgtgagacaaaactatccgctttatttggcgctagttgctccgttatggacgatattcaatactgcgactatatctttgagaaaatacccgataatcgcttatacctctctcatggcgttcctaaagcaaatggcacaaagatacaagttactgaaaaaatctcttatgatgtcagcaaggtaagtcatggtttgacaattggcaatacagggagcggaaaatcggtttggattgaatacaaaattttagcttatgcacaaatgggcgcaattatttatgtagccgatccgaagtcggcggatttatcgttattgaaatacattcatggctttgaagatagagttgtcagtgagccgaaccatatagcaagagtattaagaaaagtaacggaaatcatggaaacgagatatagacaatatttcagtgaagtttctgcgtttggtaaaacctttgtagatttcgatttaccgcctgttgtactcgtgtttgatgaatttgcagcatttatcaagagtgcggataagaagttaagtgcggaatgcatggcttacttatattcgttgattttaaaagggcgtgcaatgggttgtttcgtggaaattattcttcaacgtccagacagttccattttagacggtgctttacgtgaccagcttggttgccgtacgctattaggttcagccagtaaagaggcaaatataatgtgtttcggctcatctagcgtagaacataagacaatttctgttaaaggtggcggatatatcaagattgacggacaaggcgaagaaaaatactttgaaacaccattcatgaaagactttgatttcatagccgaattagaaaagattatcagcctacaacaaattatccccctcgaagtgagtgaaatagggaggtagtcgccccagcgactaaacggagtgtccgagtcttttcactcactttgagggggccagtcgggcggtctttgcccgacacttaacttgatatataaaacaacatctgctcgtttgagcgcgcgctgagaggtgtgtgatgtctaaagaaactcgtgcgtataatactaaaattattgaaacttccacctacattgaggtgtatcagtatgatgaacctattttctatagtcagtctgttgaaaatgaaaatggttcacgtcaattagattggttaattgatgataatacacgtcgaacttatgatgagctaccaactaatgagaaatatgatagcttaaagcgaaaacaacaacattatgaagacatgcgttgggaaattgctagaatcgtggattgtaattttgatgaagcaacaaaatttgtcacattaacatttcgtgacaatgttcaagatattgagttctcaaataatgaatttaaaaaatttattcaacgactaaatagacgattgaaaaaaagaaatcagaaagcaaagtatcttgctacatgggaaaaacagaaacgaggcgcaattcactaccatgtagttttcttctcacttggttatattaaaaattcagaacttacaaaaatttggcgaaacggtcatgtcaagattaacaaggttgatgttgatagcaaggaaaatcgtgggcgttatcttagcaaatattttgctaaagaccttgaattaaaagaacataagaaaaaggcgttttttaaatcgcaaaacttaaaaacgcctcgtattagaaaaactaccacatcacaactgtttaatttttctaatgaaaaaattgtttactcaaaggagtataaacgaaaaattcttgattttaaagagtttgacggacaacattctgtttttaaaactggaacagtgcgttacacaaaaattttaaaggagtgattcgtttgactaataacactgtaacaaaaaaagaattgtctgcattaggatttggaccgagccaatcctctgatattattcgaaaagcaaaatgtttaatggtgaataagggatactcttattatgccagtaaacgtttgggacgtgtgcctatttcagccgttgaagagattttaggttttgaaattattgtcaatgaggtacgcgattatgccgaaaatttctaatatttatcaagacaagaaaagtggcaaatggtactttgtcgctaacctcggttatgatgagaaaggcaaacgtattcgtcactgggggcgtggctataatacacaacgtgaggcaaaacgtggctatgatgattacatgaacgatttttctgattccgcaatcaaaaagaatagcaccatgtcttacaaggaattttatgaaacgtattttaaacctgattacaaacgttctgttaaaccaagaacctatgaaaatcgggtgtcctccatggacattcatttcgcctacttctctaatcgcaagttaaaagacattacaccaccaatcatcaagaaatggcaaaacaaactatctgaaagctattcatctgcttatatccgtaatatttatggactgtttcaaatgtcgttagatttagctgttactttggggttagtaaataagaatgttgctaaacaagttggcaacgtgaaaaaggtgaagaaaagagtggatttttggacaaaagaagaatttgaaaaggtaattgcaacatttgacctatcggactatcatgaacattttgcttttatgctgatttggttgctctttatgactggtttgcgttttggagaggcacaagcgctagaatgggataatgatattgactttgaaaatcaaacgttacatgtaaacaaatctatgtattataaaaatgcgaacgaattttatgtaactgaaccaaaaacaaaggctagtaatcgagttatcgccttagatgatgatacaataagactattgaaagactggaaagccgttcaaacaaaaaatgtgccgtcaaaatacgtgttgtcttacaatggactgccaacaaataagagtgctacttaccacgttatcacccagcattcgaaattagctggcattcatagaatcaaggctcatgcccttagacattctcatgcctcattgctgatttcaatgggtgaaaatgcgttggtcgttcgtgatcgcttaggtcatgaagatattcaaacaactttgggaacttacggacatttataccagaacgctaacaaagaagtcgctaaaaaattaacgaatactattgaaatgcctaaggaaaatgcgcaacggaaacttacaggcaatcagtatgtgaagcataaagaatgacgaggtgtatcaatatggaaaatactgtttttgattcagacaaatttaaagggcaaaaaataccgaaatatgattctaaatctggtgtttgggctgttgatacaggtaatcgtgttgaatttggcgatatgtattatgttttatcggaatttattgaggacgggttacattatagttttaataccttaatagccggagatgtacggcgagaccatgcacattcttttgattgtgtcgtttcagctttactcaagaatgttacccatttttcaattgtcggatttgagaaagattattctcagcaagaaataaatttcctcaatgacattcagaccaaaattttaaaagaaagtcaggattgccaacatgacagaatatgataaatttaaaaatatggctatcgaggtagcgaaaaaagctcacgctggtcaaactgacaaaggtggtgaaccttacttttttcatgttcaacgagtggcaaattcactaacagataaaaatgctaaggttgttgcctatcttcatgatactgttgaagacacggatattactattgaaaaactgaaagagttaggtttttcagacacgattgtttcggcagtacaggttttgacacaggaacgttatcaaccctattttgactatattgtagaaattaagaaaaataaactagccaccatggtaaaacttgcagacttaaaagataatatgaatctttcaagaattactaccccaactgaaaaagactttgaaagagttaagaaatatcaaaaggcgtttaaaatattagagttagagggagagtgattcaaaatgagaacacttttagtgggcgatttacacttaacagcacaaataatcttgccaatggttgagcagaaagttaaagaattaggcattaaacaagtgattttgctaggagattatacagacgcatacgagcaagaaaaaaacgttgatctttacatgaatgaattagattatttgttcatatggaaatcaaagatgaaagttttcggtgtcgaagtgataaatcttttaggaaatcatgacgtgtcttatttgacggtgacacctagaaggtattcactgcaaagtgcagatggatttctttcagttggtcgaaagctgttgaagttaaatctgcaaattgcttttcagttagatgattatttgattagtcatgctggttacacccaagactttgatttagaagattggcattttgaaaaaataactgaaaatttaatcgacaatttagatgatttagaagatcatgtcggcaaagcaagaggtgggaaatactttttaggtagtccattatgggctgattttgaccatgaattaagctttttgccaaatccaaagtatcaaaaacaaattgtagggcatacaccgcaaacgaaaatcacaaccgtccgtaaaagacaatttgaacttgtgggaattgatacatttacagttatcccaatcaaagaaagaccatttttcaaagaaactggtagtggagaaattttactttatgataatggcgcacttataccaattaaactggattggcaaagtgatgaagtgattaacaagttgaacgaaatatttgaaaaaaaatcttagtactactaagttatatggcgttatattagattttaaaaatggtcaatgtctattgatgataaagaaatctttttgaatagaaaatatctttagaatataattaggaggtttttgtatgcgggaaaatcaagtgtctataaaaattgaaagatttggcgaaaatataccagatgagtttaaagaattgaatatgcaagttatgtctgtttatgctgatggaaatgatttatatgaaacattatgtaaagcttttcagttagccttaaatgaagttggtaaatatgagcaaaataatttcggatgtagagaaagttatgattctttagaacttacacaaagaaaagttaaggggcttaaattatgtagaaaaatgaaaaatgattttaatgattctaactcagaagaagaataaaagctaatggttgcaaaatggttgcataacttcaaaaaatagagcctagactccctataaataaaggattctaagctcttttctcttattcccactccacagttgcaggtggcttactcgtaatatcatacacgattcgattgacgtgtgcgacttcgttcacgatacggacgctgattttttgtaagacttcccatgggatgcgggcaaagtcagcggtcatgccatcgatggaagtgactgcacggataccaacagtgtaatcgtacgtacggccatcacccattacacctacagagcggatacctggtaggacagtgaagtattgccaaatgtcgcgatccaatccagcattggcgatttcttctcgcaagatggcatctgaatcacggacgatctctaatttttcttcagtcaattcgccaagaacacggatacctagacctggtcctgggaatggttgacgccatacgatgctgtcgggcatgcctaattgggttcctaattcacgaacttcgtctttgaacaatgtgttcaatggttcgatcaatttgaattgcatatcttcaggcagaccgcctacgttgtggtgagatttgatcgtttgtgctgtttctgttcctgattcgatcacatcggtataaagggtcccttgtgcaaggaaagacacgccttcttcaccggccagcttggttgcttcgtcatcaaagacataaacgaattcattcccaatgatcttgcgtttttcttctggatcagaaacaccagccaatttggataggaaacgctctttggcatcaactttgataatattcaagccgaattttccgccaagactttccatgacttgttcggcttctcctttacgcaatagaccatgatcaacaaagatacacgttaattggtcaccaatcgctttttgtaagagaacaccaacgacagaagaatcaacaccgccggatagacctaataagactttcttatcacccacttgttcgcggatcttagcgatctccatatcaatgaagttgtccattgtccagtcgcctgtacattggcaaacatcgattgcaaagtgacgcaacaaatcattgccatattcggaatgacggacttcggcatggaattggataccatacattttgcgctctgcatgttggatagaagcaattggacagtctttgctggtggcaatgacgtcaaaacctgctggcgcttgggtaactaaatcgccatgactcatccaaactgtttgtttcacaggtgtattttggaaaagagcagcatcggcagaagtgacttccaattctgctttaccgtattcgcggtttttggctggttcaacttttccgcctaatttataagtaatcaactgcataccgtaacagattcctaacacggggatccccaaatcaaaaatcttttcatcaataccaaatgccttctcatcatacacactgtttggaccgccagaaaggatgatccctttaggattcattgcctttacttcttcagcagtaatgcggtggctcaataactctgagaaaacaccgaactcacgaatacgtcgggtgatcagttgattgtactgactaccgtaatcgagtacgataattttttcaacgtttggcatgttgtcaacgtttgtcacaataaattacctctattcttttagttttattgaaaaaaggaagattccttttcaacagcataagggtgaataatgaagcagtcaatattttcgcaagaatacttcatcgattgaatggtgctttgttttatggagaattatatcggctctgctgcgtgtaggcaagatatactcgtgtaaattctttaaattcacatttttccatacttcttttgccattttgattgcttcaccgcggtcgccaatcgcatactgatagtaataattgtttggtttttgaaaagccgtatccaaaagagattcaaaacgctctaaataccacttttcgatcagatcgggctgcgcatccacgaaaatcgaaaagtcgaagaaatcactgacataaatctgctggtttgcgggcagctgtaatgtattgattccttcaacgatcaaaatatctggctgattgatgatttcaaacgtatccggaataatattataaacttcatgagagtaaacggggatcttgatttcagattctccagacttcaccgcgttcaaaaaattgatcaatgcttccatgtcataactttcagggaatccttttcgatccaagatccctcgtgcttctaggacctcgtttgggtacaaaaagccatcagtagtaatcagttgcacggtgcgccgagggaaaagccggctcaacaggttttgaaccaaacgcgccgttgtgcttttaccaacagcgacactgccggcaatgccaataatgaatggcggcattttgacataacgatgcaagaaaagtcctttacttaacgtgagagattcaaattctttcatataaaggtggatcagatggcacagtggcacgtaaacatcttcgacatcttggaccgagatgcggtcattcaaacttttgatattgtctaattcttcttgagtgaaaggcatcatgccattggtgtaaaagccttgccattgctcccgaggaatttgataaaaattcatggtttcttgcatgttcgactccttcatatagaacctgtctatctttgcagaccggtacttggccttcagaaaaggctgattttctgtatctggttgctgctcggaaatattttaccatagaaatggcaggaacttataaaaaataggaaaaatcgttggcaaagaaacgaaaattatctaagattcattgaggaaacgattatcgggagtttacttctgcaggaatttgggtatcatggaaaagagtcagcaaatgaaatgcttttgattgtcaaacagataaagcgagaactatcgctagttaaaagaaaaaagggtgagcaaagatgggaaatcattattatacagagaatccggataccgcacatgattttgaacaatggtcttttgagttaaaaggaaagaaatttcagtttgtgacagatagtggggtattttcccgggagaccgtcgattatggctctcgcgtactgattgatgcctttgaatgggcggatttaccagagggaacgattttggatgtggggtgtggctatggaccgatcgggttgtcattggcttatgcatcccagcgtccagtggaaatgatcgatatcaaccagcgggcggttgatcttgcccaaggcaatgcgaaacgaaatggcatcgagaatgccgacattcatgcctcaaacatttacgaaaccttgcatcaaggcgaatacgcagcaattcttagcaatccacctattcgggcaggcaaagaggttgttcatgagatcttgacaggggctctgccgctattgaaaacgggcggcacattaacgatcgtgattcaaaagaaacaaggtgcccccagtgcccaaaagaaaatgcaacaaacctttggtaatgccgaaatcatcaaaaaagacaaagggtattatattattcaaagctacaaagaataagcgcgcaaagcagacgtttttcacgttcacaataggtttacctgttttttaaagaccacgatcatttgctaggtgaagcgacccccaaaagttagaccaaaaaatctaacttttgggggtcgttatttgtatggcaaaatatccttttgaattaaaactaaaaatcgttaaagaatatcttagtggcgtgggcggatatcggtatcttgccaacaaatacggtatttcaagcaagtataaagtaagtaattgggtgannnnnnnnnnggagacgagcagatgatgaacagtactaggggaccgaagggaacgtagtcaccacgtcccgaatcactgcgactgacatgcaaagcatggcagagcagatgatgaacagtactaggcgaccgaagggaacgtagtcaccacgtcccgaatcactgcgactgacatgcaaagcatggcatgcaagtccttcttagcgaactatgcttagaagcgactgcaggcgaagcacagagtagacgagcagatgatgaacagtactaggggaccgaagggaacgtagtcaccacgtctcgaatcactgcgactgacatgcaaagcatggcatgcaagtcacactgaaccaaccatgttcagaagcaacgataggtgaaaccacgagaaacgataaggtaataaaaagtaaatgttcataggagtcgattgaaaaaggagtgagaagatgccaatcatcatccccaaagaattaccggcagcagctattttgaagcacaacatttttgctttacaacaagagcgagctatcaaacaagaaattcgccctttgaaaattgcgatcgtcaacttgatgccgcaaaaaatcactacagaaaatcaattgttgcagcttttgtcccaaagtcctttgcaaatcgaagtaacattattgaaaatgcagcaacatgaaagcaaaaatactagctcgactcatctagacaagttttatgtcgcatttaaggcagtcagtgaggaacgtttcgatgccttgatcattacaggagcaccagtcgaaaaaatgccttttgaaatgattgattattggcaggaacttcaggaagtcatggcttggagtcaaacaaattgcacatcggtattgcatatctgctggggagcacaagctgggctgtactatcattatggtatcgaaaaagtgcttcataagcaaaaactttttggtatttttgaacagcgagtgatcgaggctcatccgctgatacgagggtttaatgattccttcatgatgccccattctcgttatacggggatcaatgaggcgcagctgccacttgcacctctgaatgtgcttgttacaggaatagagaccggtccagcactcttagtttcccatgaccataaaaatagttttcttttagggcatttggaatactatacagaaacgttgaaagaagaatatttgcgagataaagccaaagggctcaaaacggcactccccaaaaattatttttccgaccagcaaggaacggtcatcaatcgctggcgagggcatgcgtccttgtttttcagtaactggatccacgaaacctaccagcgcacgccctatgatttacagattctgccaacgcgtactggttattatataggtaatgaatgggagggcggacataggcggcagtgactttagtcaatgtttttttcagtgaaacaaaagagcgctagacaaagaaggttgatctgaaaagcccgctagttttaaaccagtgactgctgtactcatttacttctaccctccatcaatggtcaggttttccacagcgaatgatcaaaacagctcattttgcttcattgtttcacaaaaggctatgattgcttcattctactcatcaacgaacaatttggcagttaaggcaactagtttcactactatcgtcagaatcttgcgacaacgactttatcccgcttcattgagcacactaaaccaagaaaggaaaatacgattatgactgttgatatgacgacttttttagcacaactaggcaatcgttcggatcaagcgacgggagctgtcagtgcaccaatctatctctctaccacctatgcgcatcctgaattaggtcaaagtaccggttatgattatacacgtaccaaaaacccgacgagagagctattagaatctgggctggctaccttagaaaatggcgctcgaggaatcgtcacgagctcaggtatgagtgcgatcgcattgatttttgaacttttcccaagcggcagtgaatttctcgtatcaagagatttatatgggggtagttatcgtttttttgaagagttacaagcgcgccagattgcttattttcactatttcaatacgctaaacgaacttgaagaacaaatcagttcaacgattgcggcggtctttttagaaactccgacaaatccattgatgacagaaatcgatgtgtctgcggtcgccgagatcgcgcatcaagtcaatgctttactcatcgttgacaatacttttttgacaccattgagacaaaaaccgttggaactaggcgcagacctcgttcttcattctgggaccaagttcctgacaggtcacaatgatattttggctggtgtgatcattgcaaaagaagtctcccttggtgaacgcttgacctatcttgccaataccactggcccaactttaagcagcttcgactgttggttgttcattcgcagtttaaaaacgttgccgttacggtttgaaagacaagagcaaaacgcaaaagaaatcactgcgtttttaaaacgccagccagcaatcaaagacgtactgtatcctggtgtaggaggtatgatcagtcttcggttaaaggaggcagtgaaagtccgttcatttttgaaggaactctcaatttttacatttgctgaaagtttgggcggagttgaaagtctcatcacttatcctacgacgcagacacatgcagatatccctaaagagttacgggagtcctatggtttgacgccggatctcttgcggctctctattgggatcgagaatagtcaggacttgattgcggatcttacgcaggcattgtcttacatctaaaaaaacccctttttgcgagtactatagaaagatatagcgcaaggctttactagagtttctttattgacagtttttggtgtataagataaagttacactacatatgaatagttagtccgatgatcaactgactacagcaggaaatgtaaagttgtagttaagtactaagtattctatccagtcattgcgtctatttgcgacaatcacaagaaagggatcgttgcttctgtaggcttcgctcaaagggggaaaaaggggaagaaaaaaatgaaaataagttggaaaaaatgggttagcgtatttttaggcgtattggtttttgctttggcaggctgcagcaaacctgcctcagaggcaactacagtaaagcttggggttgttggagagcaaaatgaagcttgggaatatgttcaggaacaattgttggaaaaagagcaaatcaatctacagctcgttaaatttactgattatcgtcagcccatcctggcactagaggacggttcgattgatctgcacgcagccttgacagagatttttatggataatgtcaatcaggaaagcggatattccaatacaacgattgcttataccacactcaatccactggggatttattcagacaaaatcaaagacattgctgaattggctgatggtgctactgtcgcgttaccaaatgacgtttcaaatgagagccgcgcattattgttgctgcagacagccggggtgatcacattggatcaatcaaaaggtctgctgccaacgacgaatgatatcaccgataacccgaagcagctgacgttcaagttgctggacgccaatcagaccgcgcgagcaataacggatgtcgatatttcattgattaacaatgggatggctgttgatgccggatttgtgccaacagaagatgcgattttcttagagcctgtcgcagattcgtccaaaccgtattacaatgtgatcgcggcccgagcggaggaaaaagaaaatcagacgtatcagacgatcattaagtattatcaaacagatgaagtcaaagaaattattgataaagtaacaaaaaaatcaagtatacctgtatggtaagaaagtaggagaacgatgaaaaattggaaaaaaggattgattgggacagcgattatcagtataggtttattcttagctgcgtgctcctcatccagtacacaagattcaacaacaaaaacttcaactcaagcaggagataaagacacgttcacttatgcgatcagcggtgatccaacgtcaacgaatccaatcaatacgagtgaccgttgggggctgactgtcaccaacatgatctattctcctttagtgattgttgaagcggatggaacaacccaaaatgcactagcagattccgttgagccagctgaggatggcttgtccttgacggttcatttgaaaaaagatgtgaaatggtcagatggcgaagcctttaccgcagaggatgttgtttttacttatgaacaaaaagtgaaaaaagaaaacggcaatgcagatgcgttatgggtagatggaaaaccggtcagcattgaaaaagttgatgattatacagtgaagtttgttttaccttctgcaagtgcagcagcattaaataatatcgcaactgaaacgtatatcattcctgaacatatttataaagatgtgactgatttttctgttagcgaattgcctgaaacccccgtaggaacagggccttacaaattaaaggaatacaagcgcggcgaatattttacttttgaagccaatgaaaactattacggcggtgaagcagcaatcaaaaatgtgacgttgcggatcattgaaagtactgatacggctaaagtcgctttacaaaaaggcgaagtagatgcggcagttgtcttgccttctgatattgaagatttggatgattcaatgatctcagtatatccgtatactgaaaatcgggttggttatctaggattgaatactcattctgatgccctcaaagatgtcaaagtaagacaagcggttctttatgctttgaacaaaaatgaaatgaatcaggcagcgtatttgagtgatgaatattttgatacgccatattctttcttgccaccgaacaatccttacgcgaccgaagacgtggaaaaatatgaaacaaatgtggaaaaagccaaagaacttttgcaagaagcgggtgtatccaatctccaactgaatctagcatttacttcaacggatcctgcacaaacgattcaggcaacattgattcaacaacaattacagcaagcaggtatcaacgtttcattggaaggcggcgatggaacagcgatctttacagaattgaaaaaagccggttcgacaaaatacaatttatttttaggcggctatatcatgggaaatgatccagatctttatggtatgcttttcaaaacggatggcagctcaaattatttccaaacacagaacaatactaccgatgatttgtttgctaaagcagcggttgagttagatgaaacaaaacggaaagagttatatgaccagctgcaacaagccattgctgatgatgctcgaatctatcctatcgtagataataaaaagattttagccgtcaacaatcgcattgccaatgtagaagaagctggcttgattccaatctacacatttgaagatatgtcaaaattgacgatcaagtaacatgaatggttgtgacagaagtcaaagaaagacggaaaacatagacggattcgccttctttaaagttggcggatctgcaccaagaagttgggctgtgccctaagtaacatccagatgaaaatgcctgaaatggttgagatagaggtagacgctgaaggtacaaccgctcttgtatgacaggagccatctcaagtttcttcggatatcagttggatgaaatacttaggttcttgctcctctggtgcatgcgatttgttatctgtctagctgccttctgtcatgatttttttgagagaaagaagggaaaccatgttccgatatattatgaagcgagtattgcaggctattcctctgctattcgttatttcattcatcgttttttcactgattcatatcgcaccttatgatgtgatcgattcaatcacaacgccaaatatgacacaagagcaaattgatctgttgcggcaacgctatggattggatcaaccatttctagtgcaatactttctatggatcaaaaacatccttacagggaacttgggattttcattagtatcccagaacagtatcgctcaagaattagcggtcagaatccctaatacgattcgactggttctgccagcgtatctgactgcattgctgttagcaattttactcggactgttggcggcagcaaacaagggaaaagtatgggatcgtctgatcgacggtattgcttctttaggaatcgcggtgcctacattctggtttgcaatgattttgatttatctttttgggtatcggctgaatctgtttcctatcattgggatgtatactgttggaaaagaaggagatttcaacgattttctgcaacattttattttgccttatgcaacactgacggtcgcttttttcccagaattaactcggtacattcgcgcctcagctacgcaacaagtatcagaagattatgtcgttgtacagcaggcatttcacgctacgaaatggcagatttttagccgtcatatcagtcgcaatgtgttgatcccgatcgtgacgcaaattggtttggcactgccaatgctggtcacaggagcaatcattacagaaaccatctatggctggccaggggtcggtccttatttgatgagtgctacgaaaagtttggactatcccgtgatcatggcaatcatgttgctgtcagcgaccttagttattttaggcaatctattggcggatgttctttattcgattgttgatccaagaatacgtaaaggagggaatcgttcatgaaacgattgaagaaaatcagaaaggcgattttctcttctccagtttacgccttttcttttatctttttgacgttgctgattttgttgtcattagcggcacctttgattccaatcgatccgaatgcgacggatgtcagcaatatgtcccaagcacctagctgggcccatctgttcggaacggatgaagttggacgagactatttcattcgagttgtctacggcggtcgggtctcgttattagtgggagtactagcgatgattacagcgacattgatcggcacgatggtcggtttagctgctggatactttggtggttgggtggacagtcttttgatgcgtcttgttgatgtcttgtcttccattccttggttggtattagtgattgttttaagtgtctttctgcgtccgggattgacgacgatcattattgtaattggaggcttttcgtggatgaatatcgctcgtctgattcggggagaaacacttgctgcgaaagaaagagaatatgttgtctatggtaagtttattggtcggacatcctttagtattattttccgccatatttttccagcagttttacctacgctgatcgtggcagcttctgccagcatctcaggagcgatcatgacagaatctgcgttgagttttttgggaatgggaatccaacagccaatggcttcttgggggagtttgctgcaaaatgcccaaagcagtttgcaacgagccccttatatggcaattctgcccggcttattcgtgatttttaccatctattcatttaataatctgggggacatgatcaaacgtgtcttgcagcgggaggtgtagcaagcatgaaagagccattactgacggtgaaaaacttaaacgtgttttttcatagaaaacaaggagatcagcagctgctgaaagaaatcgacctagtcattcctaaaggacaagtcgtggggatcgtcggtgaatcaggcagtggcaagagtatgacgatgaaaagcgtgatggggatcttaccagaaaatatctccgactcctttgactcgtttgtttttgaaggccaaccggttgttgatcgcagcaaattaccgctagccatgatttttcaagatccaatgacatcattgaaccctttgcgaaccatcgggtatcacttgattgaagtcattcgcagacatcagaagatgtcaaaaaaagctgcgcaaacaattgccattgcggagttgaacaaggtagggatcccccttcctgaacagcggatgaagcagtatccccatgaattatcaggggggatgcggcagcgggtcatgatcgctatggcactgttggcacagccgaagttgctgattgcagatgaaccaacgactgcattagatgtaacgattcaagctcagatcttggcattgatcaagcaattgcagcgagcagagaacctttcggtcgttctggtgacccatgattttggggttgtcgctggcatgtgtgattttatcaaggtgatgtaccaaggaagagtggtagaggaagggactactgaagaaattttctatcaacctcagcatctctatacgaagcaactgctcgaggccgcccacttaggggataaagaagaaacagttgtctttgactatcaggaagaacttcctgatgtgttacacgttcgggaaatctctgagacgcatcgtgtttgggaaggaggggcaagcaattgaaggaattgatacgagtcgaagaggccagcaaaacgtttcgaagcaaaaactggcgtggggtagtgacagaagtgcgcgcagtagagaatgttagtttgacgatccatcggggcgaaactctaggccttgtaggagaatcaggcagtggtaaaacaacattaggccgtagtattttgaatctggaaactttatctgcaggcaaagttttttttgagggacaagagctggcaagtttgccaccagaggaacaaaagaaacgctatcagcagatgcaagtaatttttcaagatccttattctgcgttgaatccacgaatgactgctttggagttagtgatggagcctttactgaaagaaacgaaagacgctgcacgagcaaaggctaaagagatacttgcgatcgttggaatcaaaggagaggacatccataaatttcctcggaatttcagtggtggacaacgtcaacggatcgggattgctcgagcagtcgttaatcgaccagcctttgtcttgtgtgatgaaccaacttctgcattagatgtgtcgattcaagcgcagatcattcaattacttctaaagctgcaaaaagaattttcattgtcctatttatttatttcccatgatttatccgtgatccgtcatatcagtgaccgcaccgcagtcatgtatcaaggaaaattggttgaattggcgccaacaaaacgactctttgaaagccctcagcatccttatacaaagaaactattggcagcagcaccaatcgctgatccaattctggctcgagcagcaatggatcagaaagacatccaagaaacgatcactttaagtcctctttttgaatggatagaagtagaaaaagaacattatgtaaggagagaaaaaaatggcagttgaaaccttaacactggttaaaggaaaagataaattagaattaccacagcaaaatggcaactgggtcttggctcgggaactaggatactcaccggttcagatgcttgtaactgcagccgcagcttgtggcggttatgtgtatacttctgttttggaaaattctcatgtgcctgctgagattgaaaaaatcgaagtcagttatacgagagattctacgaagaaagcagagccgatctcttcgatccagatcaatttttatgcgcggatttcagcggaatatcaagaaaaagccattcgctgtctcaaactcgtttctccgaattgtccagtcatccaatcattagatccaacgatcacggtagcagaaacagttcatttcatttaattcaaacaacacaaaacacgttaaacaaaaaggcagctagtcaaaagaaattcgactagctgccttttttaataaataatattttcgcgaattgacccgatatctaaaaccaacagtttccggtcttgagtcttgatagcaccgctttctctcaaccgctgcatcattcgattgacactacttgctgaagtgataccgcaaaagcgggcgatttcctcattggttacctcaaaatcaatcaaggttccttcacccactggtaccccaaaggtttcgtataattcattcaattgtgtacagaccgcaccaaatttgccattcatcagcatttgctgcatttttttcatggagtacattagatttttgcgatagtactctttgacataatcttgtaacgcccgattttgattgacatctgtccagaattgatcgcgcacgatcttatataattcggcttcttctgactcgacacgcacattgaagggcgcttcgacttcttgtgaagattcatctttaaaaagagaaacaatatcgaaatcattcatatagcgcaaattgaattcacgcccctcatgagtgacgacacttgtcttgatgatcccttttttcaaaatatagacataacgatcagggattccttcatacgtcaaataacttctttttttacgtatgactactggaatattattttgttctaaatagtccattaatagctgttttaccaaacaaagcactcctcttattcctatagtgtttccttttcaatgaacagtcacattcgccaaatctgggtgaatattcttttttaattaaagaacattctaactcaaaaagcaataacaaatgttaatgtattatgtttttgcgttttttcagcaacaaaagcgaatttgcgctcttgaaatatcaggtatagttagacctgtcatctgagaaagaggatgatgaaacaaagaaacaataaaaaaggagcaaaacacaacatgtcagaacaggagcaacaaacagaaaaactatggaacaaaggttttattactattacattgattaattttattgtttttctggtctattattgttttgtcgtcatcacggcaaagtttgctacgcaagaattaggggcttccgctgcacaagctgggtttgcagcagggatctatattataggaacattgattgcccgcttgtatattggtaaggtattggagctagttggacgaaaagccatcttacgttggggaatgattttttatgtcataactacggcggcttatttgatttcatcgaatatcatgattttggatggtgtccgtttcttgaatggtttcgcctatggagcagtgtctacagcggcaaatgcaattgttacggcgtacattccctcttcaaaacatggagaaggaatcaactactatggattaagcacgagtttagcagctgctgtcggtccatttatcggaatgctgctgttaccctcttttggttttgattttattatcctattagcaactgctctttcgatagtaacagccattgcttgtttcgctttcccagtgaaaaatatttccttaacaccagaacaccgagcagaactaaagaaatggtcattcagcagttttgttgagccaaaagtcttgtttatttcaggtctggcctttttgattgggttgtcttattccagtgtattaggtttcctttctatttatgccggaaaccttggcctagaaaccgcaggcgcattcttctttgttgtttatgcattatccgtaaccttcactcgaccaatgacaggtcgcttgtttgatcgtcgtggtgcagatgcagtgatgtatccaagttttatcttcttgacattaggattgttcttgttgagtattactggcaatagcttgatgctgttgatttctggctgttttgttggacttggctatggtacattcatgtctaatggacaagccgtatgtctaaaagaagtcgattctcatcggatcggtgttgcactttctacttatttcattggtctagacttaggattaggtgtcggtccttatgcattaggtagcttaaaggggatgtttaattattctcaaatctatatcatttgcggagtgattccggtcgttgttattgtactgtacaaattcttttataaaacaaaaaaagtcgtcgaaagcgccgctatttcagaacgttcgagagaagaataaagacaaggagtgtaggaataatggacagtaatcaattgattttagaagcactgaaaaatttggtaaacaatgtcaatgaattgaacaaagaaatccattcgatggaagaagtaaatcaacgtttgacgatcgagcaagttgagattgctcacgaattgaaaaacatcaagcgtgtgttgatcaacgataatatcattggctgatcaacgttaatcaaagtggcagagcagtggtattgggttccattactgctctgccttaatttttgcccaagatacggcaaaaaaacgaacgattcttaaaaaacagctgtcattaaagggactaaaattgaagaccactagaatctgtgctatagtttgtctgggtagagatacctaaataaatcagagtaggaaataaagcgttaagtgtcgaaaggatgggatgttgccttttggacgaagaacgattcgttcgcggttttattttcgcattcgctgcatgaatttgtagcagctctaaaaggagatgctcgttatgaaaagaaaagtcgacgcacacatgatcgcggtcatggggcttttgattgccctgatggtggtcttgtcgcaaatcttggggtttgaaacagcctatttgaaactcaccttcacttttgttcctgagttgattatggggatgctttttgggccattctggactgctgtaggggcttcggtcgctgatatagcaggaatgattttattccctaaatccgcttatttcttcggatttacgatcaatgcattcgtaggtgggttgatctacggttactttttttatagaaaggaagtaacttggaaacgggcagcaacagtggtcttgctgaatacccttctgatcacattgattttgacaccgatctggttggcaatgatgctgaatattccattaacaagctgggcaatttggtcggctcgattgatgaaagctgttatcatgtttcctattcagacagttttgatctactttgttgggcgcgcagtgccttataaacgcttgactcggcgttttacctaatcattttagcaacaaaaaaagaataaaaaacaaacatccaataaagcgaacagtacacttgagtgtgtcgtgttcgctttttttaccttaaaaggcatgctaaaataggctgatgtaaaataagacgaggaatttatgaactggaggaatttatgaataaaaaaggaatccttatgggtggctttattttgcttctgttgctcattataggaggaatgaagtggctgatggaccaacagtcaaatggggaacaaccgacaaacgcttcacaaacaacgtcaacaagttctctaagtaccgagtcgagtattcccgaacaatcaactgaggaggaaacgacgattgataagcggattgaccaaatgagtctagaagaaaaagtcgggcaactattttttgtacgagtgcctgaaatcaatcaagtcgaagatatacaaacctatcatttaggcggctatgtcttattcggacgtgatacggagaatgagacagctgagacgttgaagcaaaagattgctgattatcagcaagccagttccatacctttgctgatcggaatggacgaagaagggggaactgtcactcgaatcagtcgcaaccctgcattggtacaaacaccatttttatcccctcagcaactttaccaacaagggggctggcaagcaattgaagaagatactgctcaaaaggcagctattttccacgaatatggcatttctaccggtctgtttccggtcgccgatgtagcgactgatccgaatgcctttatctacgatcgaaccataggcttagatgccgaaggaaccagtgaatttgttcgtagaaacattgcagttttgaaagagaagcggattggctcaacattgaagcattttcccggatacggcaataaccgtgattctcatgtagagatcgttacagatgaacgttcgttagacgagttggaaacgaatgatttcttgccttttgaagctggaatcaaagcgggagctgacagtattttagtctcacataatattgttaccagtattgatgccagcgcaccagcctctatttcgaagcctgtccatgatttattgaggaagcagctaggtttcaaaggagtaatcatgacggatgacatggatatggcgggcctagcagactttatttcccaatcagaagcagggctgagagcattagaagcagggaatgatttagtgatgtcatctacctatcagcaacagatcccagtgattgtggatgctgtcagaagtggtaattatccggaagcagccatcgatgcttccgtcaaacgagtccttgaatggaaaacttcccttggattaatcaattaaagaaaacgatctgaaagtcactgtttccggtcaccatttattggggccgaaaaaaggcattcagatcgtttttttttcttacattgattttgagaacaacgacattataagaaaggttcttcagaaggcgctacggtcaacaggacgttggttgctaattctgttaattcagcggcataggcagattgtcctaaaaagtttaggatctcaatagtctttgaaattgtttgtttcccagtttcgatctcaccatggaaaatcgcgatgattccttcaaaatagcggatcatcaatcgaatccggtcattgtctaatggaatatttttggtcatataaaacaaaatttgtttaagatgatcgatttgactgcggtcaatgaaaagaaaggcagcgttggtcaacagcttagaataaatatgataattgagactaagcaagttattataaaactcctgcttattcaattgctcgatttgaaacaaaatatattcgtctgtaaaaagaaacattagatttgcaaaaatggtgatttcaaatcttccccaagtttcgattttgtcgagataaccttttatcacggtttcaattctttctgtttcatcgatagtatgtacgtatccctttttcttcaagatcaaatagtattggctataaagcaaataatagaaaaagtcttgcgtttcctgatacgttgttttagattcttcgatcaagacggccagctgatcaaaatcatgttggtaataagcattgtgaaattgtttcgagagttgcttcttttcatttaattgattatttgtcaaatggtattcaaattcttcgagagtcacattcaagcgatcaaggtatttgtaaaggatatcaaaagcaattcgatgccctttttgttcaaaagtagctaatgtgctccgctcagatatatcggctgctaactttctttgggaaagattacgttcagtacgtaactttttcagtaatagattggcttccaaaaaagcacctcctaaatgcacctagaaaataggtggacgaaaaaatagtccaaatcaactatagtcctattttccaattaaactaaaggaaagtcaattaaaggaggaaaagaaaatgtttcaattatttggatttccatgggaagttgttgaaaatatgatcaacattttttctttcttacgctaaacgttcgttcagtaaatctgattgaattcagatttcgatagcgcaaaaaataggtggtttctagtaataatttactatttgctcctccaaggtcgttgacctctccccaaagtcctgcttagcaggcattccaggctgtcgatcttaggaggaaacaggaacttgaagtaggaaaaagcaggaaaacagcgatttctgcttttttctatgttaaatcaagaatgatagacagaaaaccagtggcattccaaaaaggaagccactggttttttagtttatcgaaaagtcgttgattgtcagatattcctcccataaagcgtcaaataatggcgacaactcttttagagtctcagtttcttccatgacataagcaggatactcaattgctggcaacaatctatttgctggaacgatgtaatagtcaaagtctttttcgtggtttcttacgatatcatagtccacaaattgaatgtgatccagtaaaaaactgatttgctgaatggctgataaattcaatgaaggaatgattcccacctgtaatttttgtaaatgatgctgttgataaaacggatatatgaaaaaagtcagatagtctaggactagcgatttggcttttttgagccattcataaccaacacgtcgagtgtattttgtcaaaaatggacgaatctttttctgtagatttgtaaatcctttcttttgaaaggatagattcaactcattttgagaccaaaaatcaatcaataggccattgtttgcataaaaaatatacagaataatgaagctatctttttgaatttcagaaaatacttcttcatcaaaagggatcccaacgatttctggtaataatacgtgactaaaatcagccataaactcatgaaaaataggatcatcttctttgatctgttcatagaaatcacaaagtagagcagctctttctggtgttggctcagcgaaacggactagaaagaacagcattcctttgacataattgatctgataagttacttgcttttcgtcagtcataaatgccgtaaaataattttctagaggatggttcatctttgaaaataatttttcaaaaccattgattgggttaagcaaatagccttgttcgaaacgaagtttggatacaaataaaatgactaagatcagtcgttggttaacaggagaaaacttttgtaatgctaattcgttgatcaaaaccgtttgatcactgaagtccgttaagtaatccgcttctaatggtgagttctctaaataagttaaaatttgaacgtaaaaggaacggatattgatttcatttccagtcagtttcaactgagaaacattcaaatggatttcttttcccaataaataagtattcaatggtttaagtgcccgggtgatcgttgaatgactgacaaaatgaacggttgaaaaatcattgatggtcatttccgggttcatgatcgatgtaagtagaagttggaaagcaaggctttcctgaatcaaatacttctgataaagtgaataggaaagtggttcttctaatgaacgaaccttgaaacctttttcacataacgaaacttgataaagcgctgaaaactcttgttgcatttcctctatgagtggtgctatcccgtgataagacaagcccagatgctcggcgattttactgatattgattggttgattggtattctcatttaaataagtcaaaattgctaattttttctttgcatgattggtgagtaacagatcttcaaacataatcatcctccttttaaaaatattatcataaatattatttaataatgaatcaaaaatgtaagtttgagataccaatttttgattaaaaaagttcttcttttgtcgtgttgtgtaattaaataatctcggtgtaaaattatcattggattttatgtgaagaaaatcgctattcaaaaatagcagattttctctttttttttatgcgtttttttagagtaaaagaatcactatagaataattattcggtctttaaatatatgtacgtaattaataaacgaacgatataagaagattttttgtttttaaaataacacataatacctgttcctacaagttaaaaaacagtgacaagtgcatgtacttatttttatctatgtgatttcagtaaatggacgatgctgatccttaggaaatcctacatgctgaacttagaaaaaggcggtataaaagctttttgacgattattcttagcgaacaagagagatgttagttgtgcttttttgtttacatggaaataatctgaaaaattgttgtccatttaggggtgagaatggttaggagacaattgagaatggcgtgggtttcttcaaaaacgattatttttattatctttcaagaaatggtgacaaaacctaataaatataagttgaaaagctagtgctgatgaatagaaaaacaaatgtatttttacttctgggcgagcgataagtcggcttgattgataaaaaaacgtagggttgttagactggttttagaggaaaaaaaggaggatgtaaaatgaaacacggatttagagattatttaggagcaaatgagcgggaggcaggttataacttatcttggggctctattttcgcaggagtcgtgacgtttattgcattatttatgacattttcattaatcggctcagcgatcggctttggcatggtggaacctacctcaaacaacccattggatggtgtgggaacaggtttgatgatttggactgttgtgacattgattctttcattgttcggagcaggatttgtttctggtgtagcagctagacgcgttggtttggtacatggatttcttacttgggcaaccagtatgatcgttacaatcgtcatgttatcatatgtaacaattggggcattttctgttgtcggctcattactgggcaacattgcttcagctgtcggaagtggcgtagagaatgtcgcatcgggaacagcagatgtcgcatcaaaggcctttgatgagatcacagggaatatgggagatattaataccgatcaattggaaacggatgtccgcgatgtattaaaagatactgacgttcctgaattacagccaaactacttgcaagatcaagtttctgatgcaacgagcgatattaccgatgcagggaagaaaattgctacggatccaaataaagctgacgaaatcatcgatgatctttcaacgaagctcaaagatcgggcaacaaaaatcagcgattctgttgacgaagaagccatttcaaatgcggttgcgaaaaataccgatttaaatcaacaagaagcacaagaagcaacacaaaatattgtcaatggcttacaaaaagcttctgatgaagcacaacaacaaattgaaacagcacagcaaaatcttgaacaagcaaaacaagatatcgatcaagcagtcaaagatgcgcgtaaaaaagctgatgaaataagtgatgctactgctaaagcatccatatggggctttatagcaatggtcttaggactagttttaacatcaatcggcggcatggtcggtgcgaacttagtcaaaactgcggatcacgaaaatcggatctaaaagtaaaagatacccacaaaaatagggagtaaccaatcatcaatggaggattccaatggaagccggttcattgatgattggttttttatagcaataagtcattgcctccaatggaaaaaacgtaagcgattaagattaagaaatccacccatggcctctctggggaagctattttcttagatttgagaaaaatagccggagtgcgaatggctggattttttttggctcttttaagaattatgttacttactgttttggcaataataagcgcacagtcgttccttcattgacacgagagtcaactgtcaggccatatttttccccgtagagtaatttgattcgttgatcgatattctccaatccgataccagaataatgttcgcttgtctggttcctaatcaccgaagatgcttcatcaaagccgatacctgtatcaatgatttcgatgactagccctgatttactgatacgagagaagatttgaatgtaacctttctcttcttcaggaaacgcatgcagataagcattttcgatgattggctgcaagatcatttttggaaccaaacaattttcacattcttctgctgagaaaatcgctgattgaatccggtcaccataacgaacgttcatcaagattagatattcttctacgatggcgagttcatcttttaatggaacgatctctttgcggttgaaggtatggcgaagcaattggacgaaactatcgatggcttgtgttgctttctcctgttcattttgccaaatcaaaaatttgattgcggtgagtgtattgtaaacaaaatgaggttgaatctgcatttgcaaggaacggatttcaaatttgcgtttttccgcttcagtaatcatcaaatgatcgacatacgattctaaatcctcaagcatcaaattataggcacgtcctagttcctgtgtttcataggtcccgttgatcgagaccttgttgctgaaatcaccctgtgtgactgccggtaatttgtcgatcaactgataaattggttgtgtgatcgtacgaatgatccagaaagcaaacaggctaaagagcaagatactgagaaaagcgatccatacggcaggcttgatcagattcatgttgcgtactaaatgtgattcatccagcagatcataaaaagtaaactgataagaataaagaggcatctgattcactgaatcatttttcacttcgatcatagctgaatcaaaagctgtacctaatttttgttcttcagaagtggataagatctgtccctgatcattgaccacatagatggtatgcagcgttgtgtctaacaattgccgatagatggaagaaaaatcagattctttcaaaaaaatcaatgcataaccgaataaagcatcgtctttcattaatttccgcacgtacatcagtcctggtgaatggctcgtagaagtgctcaacccttgctccagaaaatagtattgactaatagcctcattttcattgatttgctgcgtaaattcacttgccaaaaaagtttcaaccgactggtttcggacagcatcattttgaaagaatgatcgtccgttcgttccaatcaataccaagttggaaggaatcgtttgaaaaagcgagcgagtatctttcaactgttcattgagttctaaaatcgttcttccctgatttagctgtccttttaaataattttctacggctttgctctcatcgacgacatcaaaaatacgattgatattctcattcaagcgctcataatcttcctggatcttatccaaaagcaagcggttcgagctctgatacgaagccacataagcatctttggaccgtccatagataacgatcactgtcagtaaacaaacactgattactcctaccacaacaaacaaaaagattcggctgaacaattcattttttttgagccactgttggattctcataattggttcaaccgccgatacttagaaggagtgacttgaaattcttttttaaagattcgagaaaaatagctgatatcggaataaccaactgcttcactgatttctgacaaattcaactcagattgggtcagcaactctttggctttttctagacgtgtattttttagataatcagagaaactcatttttaattttgaagaaaggaaagctgacaagtaggtataactaaagtggaacgtttctgccaactcagatagtgagaggctcttcatataattgtcttgaatgaagcgctggatcgagaccagtaagtcatcttcatccataggggagagggctgtcagttgcagtcgtatctcatcgatcgttgacaacaacaaatcggagaaatcctccaaatataagacatggccgatctcatgaagaaattccgctcgcaagcgactaaagcggggggctgttggaaattcttcttctaaccgggataatagcgtataaaaaatactgctggcctgctgttttagaaagttcggatcaacatttgatagaatcatctcattgaaatagtcttcgatacgcgtaatccccaacaggaaattattgtctaataatgcccgcaaaaatttttttgtatcaaaacgatcactttccatgtacataaaaagttcatgctcaaaaacaagccgctgctgtttgtaaaaaaacgattgttcccgacttttatctttgagagtcagaaaagctgtgcgtaagtcgtcaatcgattcaaacgggcatccaagggtaaaaaaggcatttggttcggtataggtcaactggtccaaacattttttcaaagaggaaaaaaaatcatattctgctgaataactgatcaatagccctgcatcattgttactggtcttgaacgctaatgtttttaagtgagtattcgattgcgaaaattctgtcaatgcatgaaaaagctgttcagtagaacgaaaataactgacattcgtataaagaaaacatagttgctgtttcatagctatttcaagatagtcagcaaaaggagtaagtggttcttcatacccagccagatagcgattcaaagattcttgtaatgggacctcagcggttatttggcgggtatcagattttttttcgcggatggtgtttagggctttcagcaacaaagcaggcgtcaatgttggctttagcaagtaatcaatggcaccgttcttaaaagactgactgacatagtgaaaatcatcataactgctcaataccagaaaatggatagatgggtattgttgttgaatgatggttgttaattggatgccgtccatttgcggcatttttaaatctgtgatcacgatctctggctgtaattgctggatcaggtttagagcctcctgtccgtttgctgcatctcctagcaagcgaaaaccttcttgctcccaacgaatcatatgttttaaaccatcacgaatagtggtctcgtcatccacaagcaagactgtatgtaaatgatgcatggtatcccccctatttctttattctagtataaacgctttcataaaagaaaggtattggtaaaaattttctatttttggactattttagtaagctcttccacgcgtattgtatccgtttacaactccagtgtatagtaaaaatgtaattaaaaggaaagagggagaaaaatgaaaaaattgcttgcatcacttgtgactgccgctactgtattgacattgacagcttgtggcagcaacaacgaaagtactggtgacactggaggttcttctgataaggttacagtttgggcttgggatgagactttcaatatcaaagctgtcaatgaagcgaaaaaggtttacgaaaacaaggatgttgatgtggaagtagtgaccatgtcacaggatgacatcgttcaaaagttgaacactagtctagcatcaggcaatacggatggcttgccaaatatcgttttgatcgaagactatcgtattcaaggctatttatcttcctatccggatgctttcagcgacttaactgatattgtcaatgaagatgacttttccagctacaaattcgccgtcaacaaaatcgatgatgtgatctacggtgtaccttttgatagtggggtagcagggctgttttatcgtacagattatttagcagatgcaggatatgaagctgctgatctccaagatattacctgggatgactttattcaaattgccaaagatgtcaaggagaaaacgggacatgccatgatgtctctggatccaagcgatttgggattggcacggatcatcatgcagtcagctggtgaatggtataccggtgaagacggcaccacagtaacgattaaagacaacgaatcattcaaagccggcttgaatgtattggcgacactactgaatgaaggattagttgaacaagtctctgattgggatggcggcgtcaatgcagtccaatccggaaatgttgctgcagcaccaacaggcgcttggtattctagtacgattcaaggggctgaagatcaaagcggcaaatgggcgattgcaccgattccggcactagctggtggcaattcagtgaacgcatcaagtattggcggagcaggatggtatgtcattaaaggcgtagctggtgaagagaatgcgaaagactttttagcgaaaacgtttgcttcaaataaagaattgatgggaacattggcaactgaaattgggctggtttcaacgatgaatgctgccgaagagacaaaagaatatacttcaggacttgatttttatggaggacaaaaagttttccaagacttctctcaatggtcacaagagatcccggccgtcaactacggcaatcatacttatgcgatcgaatctgtattgacagaaagcttgcagcgagtaatcaatggggaagatatcgataaagtactagaagatgcacaaacacaattagaagcacaaatcgcaaactaagccactcatttagctatggtttcataatcaacaaatcagatacgaacgatagctgctggtaccaataatttcccattagaggagactgttaagcagcaatcgttcgtatagtcattagattggtgccatagtgtcgtttgaaggaggaatcaccatgaaaaataaatcgaaaaattggtttgcgaatggaaacgcgtttatttctttgcctgtgatcttgattacactattagtatttgttcctatgatttcagctctttttacgtctttccagtcgggaccgccgacaacgatgtcattcaacggtttgggaaactatcagcggatgctgagtgactcaaccttcaagaaagcttttggtaatacatttttatacttattaatccaagtaccgatcatgctgtttttggcattgatcgtctcgaacatactaaatgacaaaaaattaaaattcaaaggtcttttccgaacggccttgtttttaccttgtatcacttcattggtctcttactcgttgatcatgaaaagtttattctcagcgaatgggttagtcaataattttttaatgcaaattcatttgattgaggtgccgattcaatggctaacggatcctttctgggcaaaagtcttgattatttttgccattacttggcgctggacaggctataatatgattttctttatttctggtatgcaaaacattgatcctagcatctatgaagctgctgaaattgatggtgcgactaaatgggatcaacttttcaagataactattcctaatttgcggccaatcattttattcacgacaattacttcaacgatcggaacattgcaattatttgacgaagtacaaaatattacaggtgggggacctgccaatgcaaccaccacgctctcgcagtacatttataatttaagttataaattcaccccgaactttggctatgcggcggcagtatcctttgtgatcgtgatcgctattgtggtcttatccgtcatccaaacaaaattaggagggaaagaaaattgaaaacactctctttaagcttaaagtatcttttcttaggtcttttggcctttatttccgtctttccatttgtctggatggtattgggaatgaccaatcaaacctttgacattgtggcaggaaaaatcatgatcggtgatcagctggtgatcaatttccaaaatttatttgcttctgaactgaactttactcgtgctttgggcaactctgcagtgattgcggtcattacgaccgtcttcgcattgatgttttcttccatggcgggctatgggtttgagatctatcgagccaaaacaaaagatcgcattttcaatattttactcttatcgatgatggttccttttgcggctttgatgattccgttataccgcatgtttagtcagcttagcggaaccccaatcggaatcaatacttttgcagtggtcattttaccttctgtttgtacagcgttcctgattttctttttccgccaaaatatcaaagctttccctaaagaattagtagaagcagcccgcattgatgggctgaatgagttaagtattttcttccgagtctatatgcctactgctaaaaatacgtatgcagcagcagcgatcattacctttatgaatagctggaacaactacttgtggccattagttgccttgcaatcaccggataaacggacagttccgttggttttatctgcgatgggggcttcctatacaccggattacggcatgatgatgtgcgggatcgtgatcgccactttgccaacagcgattatctttttcgtattacaaaaacaattcgtacaaggcatgttaggttctgtgaagtaaagaaaagagaaaacgaggaaatgaaatgatccattttgataaaaaaaaccaaatttttcatttaagcaacaacaaaatcagttatgtgatgcagatcgaagaaggtggaaatttagcgcatatctactttggaaagaaaattacccattattctggccattatcgttacccgcgattagatcgttctttttcgccgaatccagcaggcagcaaggatcgcttattctcgctggatacgctgatgatggaatttcctgggaatgggttcggtgattttcgtgaagcggcatatgatatccaactgccaaatggcagtcatgttgcgcattttatctatcaaagccatgaaatcagtcaaggcaaaccagcacttgcggggttgcctcaaactcacggtgctccgcaagaaatcgaaacgttgcaaatcatattgcgagatgaagttgccgcgcttgaattggttttgaattatagtatttttactgatacatcagcaatcattcgttcaagtgccttaaaaaatgacggtcttgaaccaatcgttatccatcaactagccagtcaatcactggattttcccaaccggccgcttgatttgatccaattgaatggtgcatgggcgaaagaacggcaaatcagtcgagaaccagttcagacaggtatcaagaaattggacagcaagcgaggttccagcagccatcaacagaatccttttgttattttggcagatcccgctacaacagaattctcgggagaatgttatggcgttagtttactgtatagcggcaatcacgaaacgattatcgaaaaagatccttatgatcaaacgcggctcatcatgggcatcagtagttatcgatttgcctggacagtaccacctcaggaaagcttccaatcaccagaagtggttacagtttatagtaatcaagggctcaaccaaatgtcacaaacctatcatcgcttttataatagtcatcttattcgtggacagtatcagctgactgaacgtccgacgttgatcaataactgggaagccacttattttgatttcgatgaagaaaaactggagcagatcgtcgatgaagcgaaggcattgggaattgaattgtttgttttggatgacggttggtttggtgcacgagaaaatgatttgacttctctgggtgactggtatgagaatgaaggaaagttagcttctggtctgcgagggtttgcggaaaaagtccatcagaagggtttgaaattcggtctctggttagagccggaaatgatctcagaagcgagcgaattgtatcgtcagcaccccgagtgggccttaaaagtacctggacgttctcccgcattaagtcgcagtcagtttgtattggacttttctagagaagatgttcggaaacatatttttgatcagttagcccttctatttaacgaagtgcccgttgattatattaagtgggacatgaatcgcaacatgacggatgtctattcattattgttagatcctacccagcaaggggaggtgttccatcgctatattttaggtctgtatgactttttagaacgattgacagctgctcatcccactattttgtttgaaggatgttctggcgggggtggtcgttttgatgcaggtttcttgtattacatgccgcagatatggacgagtgataataccgatgcgatagcccgtttgaaaatccaatatggaaccagcctgtcatacccggcttctagcatgggttcgcatgtttcagcagtgcctaaccatcaaacacagcggatcactgacttagcgatccgcggaaacgttgcaatgtctggtgtcttgggctatgagctggatttgacgacagtgaccgatgaagaaaaagcagccatcaaagagcaagttgccttttataaaaaacatcgacaactcttccaatatggcacgtttattcgcttgttgagtccttttgcaggaaatgatactgcatggatgtacgtttctgaagataaacaagaagcgattgttttctatttccgtgtattagccgaagcatctgcaccgctaatcactctcaaattggcgggattagcggcagatacagtgtatcaaatggggggatataaaatcggcggcgatgaattgatgcagatcggtttctatattgatcctgctttatccggcgactatgcaacacaaatggttcatctaacagcgatcaacaatgactaaggttcttttcagtaatcactatcaaatgaaatcaaacgaatagagctgtaacagaagcaaaagcagacgaaatgatccaaactagacatgagaaaaaattcttttctctgtgactagggacgaggatcggattgtagagaggattcgatgtgtcttcggatcgtttgtttgttgaagtgcttatgtttcagttttttctagtagagttgttttttctgctaaatcttttacgtataaatggcgattgttttatttttttgttgatttagcttatgatgaaggcggtcaataaaagtcaagcagtgacggagggaaaacaacgacagagcacttaaaagaacacgcagaggaacagttgcttgctgatgggtatcgcaaatatcatggctcagcattcgatgtttattctcacaaagacatttgtattcacagtgggaagtgtgtttgaggtaatccaactgtttttgaggtaggacgtcgaccgtgggtcattcccgataatgctcaaaaagaacaagttgctcaagtgaaccaaccttgtccaagcggcgcattaaaatttattcaaaggggagaaaactaatggaaatcaaggaagaaaaaaatcgttttgccttattagacggcgagaaagagatcggcgaaatgacttggtcgaatgcaggaacaaaacgaatgatcattgatcatacttttgtcgatccagcctatcgtggtcaaggactggcagaaaagttagtggcaaaaggggtagaaaaagcgcgcgcggaaaagaaaacaatcattccactctgtccatttgcaaaaaaagagtttgaacgtaaaccggaatatagcgatgtttggagtaaataacaattctcaattttaaaaaaagaagtggttcttttagggaaccacttcttttagcgttaatctatcaacatgtgactgttaatgttgaaattgagcatggtagagacggtaataataccctttttccgctaacaattcttcatgagtaccttgttcgacgatttgtccggcatccataaccaaaattttatcagccgcacggatcgttgataagcggtgggcaatgacgaaactggtttttccttccatcattttcaaaaaggcatcctgaattttcttttctgtcagtgtatcgactgaactggtggcttcatcgaggatcagcatcgggggattactgatcatagtacgagcaatggtcagtaattgtcgctgcccatcggaaatcttgatgccttgttgcccaatcggcgtatccaatttatctggtaaccgcataacgtattcatacatatatgcattttttaaagcatcgtatatttcttcatcggtagccgtgtcattaccatattggagattctctcttaaagaagcatcgaacagccacgtgtcttgaaggaccataccaaaactctttcgtaacgctgttcgctgcaattgacgaatatcgacgccgtctactcggatagttccctgatcaacatcgtagaaacgcatcagcaaattgactagtgtcgatttaccggcaccagtctttccgacaattgccaccgtttcacctggttcagctgtaaaagaaaagttttcgatcagtttttgtcctggatcataagcaaaagccacattttcaaagtcgattttacctttgatttccttcatcgcttgtgttgctgtgtcatccgcactttctggcacttgatccaataactggaaggttcgtgccaaaccagctaatgcagtctgaatctgagtggtgatgcctgacagttcaataaatggttttgaaaattggctagaatagatcgtaaagcttgaaatcatcccaactgttaccagccccgagcctgaaaagtacaataaaccaccgacgaagccgacagacagataggaaagatggtcaacaaaacgggaaagcggattggtcaacgaggaagaaaactgtgcttttcggccacgaaggtttaattcgtcattgatcatttcaaactgttcttggttgattgcttctcgttcaaatgctttgacaattttttgattgccgatcatttcggtaacgaatccagaaatttcaccgacgatctcttgttgacgcgcaaaatctgcttgtgatgttcgtgccacgatccaattgactaaaaagatgatcggtgttgaaacaagaacgacgagagtcagtggcacactcatcttaaccataactaccaaggcaatcagcacgacagagataccggagaataattggttgaagacagcagcaaccgcaattgagatattatccatgtcattggtaaaacgactgacgatattcccgtgagacgtttgatcgtaataacgcaagggtagtgtatttaaatgagcaaaaccttctttgcgcagatcagcgacagacagataggccactcgattccctaatcgttggatcagccattgactgacaacagtaacgatcactacaccgccaaacaacgcgagaatgcgataaagttcttcgaaatgaaccttgctaggaccaatcattttatcgacagcctgacctatttcataagtcataaaaaccgttgagatgccagcagcgatccctaaaacgacagcagtccaagtttctttggcatacacagcgagataggggaggtagcggcggaaggcagaccaatcaaatgatttctttttcattcttcttcctcctcttgagatgccacaatttcttgataagctttggaagtgatcatcaactcgtcatgggtgcctttggcgaccagatttccctgatctaacactaagatctgctgtgcgtcttgaatcgaacgaacacgctgagaaatgatgataatcgttccgcgaattttttcttttaaagccatccgcagatccagatctgtttggtaatctagcgcacttaatgaatcatccaaaatcaatatatcaggtttagcaataattgctcgagcaatcgttaagcgttgtttttgcccaccagaaaagttcttgcctccttcaaaaatcggcgtatccaacttttgcggtagtgcttcgacgaagtcgcgactttgggcgatctctaatgcttgccagcattcctcgtctgtcgcatctttttttccccattgtaagttttcacgaatcgtaccagtgaacagaaccgccgtttgaggaaccatggcaattttttgtcttaattgtttcagcggccacttgcgtacatcctgtccatcaacgatcactttaccagcagctgtgtcataaaaacgcgggatcagttgcgttaatgtcgatttcccactgccagttggaccagtgatgcccaaggttgtgccaggaacaatctcaaaatcgatattttttaatgctaagccatagttaggtgaaaagcgaaagtccacatgttcgaaacgaagggcacctgcctgtttttgttgatccataaaaacctcagataaactatcatcaatcgacggttctgtatcaagaacttcattgatccgtgaagccgaagcggcagcgcgagtaaaaatgatgacgagattcgatacaacgatcagtgccaacagcatttggttcatataattgaccaacgccagtacttccccctgttccaagtttccgatgttcactttgaaaccgccaaagtaaaagagtgcaataattcctaagttcataatcatggttgtagccggggtcaataatgcagaaagattggtcacacgaatatagacattggtcaaatcatctgtggcttggtcaaaacgtttggtctcagtttttgatcgagcaaaagcacgaatcacgcgaataccgctcaaattttggctgactagttcatttagttcgtccaagcggatctggactttcttatataatggcactgtcttgctaatgatccaaaataaaatgatacaaaaaagtggcagcacacataagaaaatcaagcccgcttgccaatcgatgacaaacgccatgatcactgaaccaatactcaaaaaaggtgctctgacgactaaacggatcaacatagccaatgcaacttgcatttggttgatatcattggtcattcgagtgatcaacgtatctgttccaaatagattcaattcattgtgggacaacaaattgatttttttcattaatgtattgcgtaattccgtgccaaaaccttgagaagcagtggctgcatagtattgacagatgaccgcacagatcatcccgatgacggacatcgcaatcatccagagggtcatttcaactactttcgaccaattgttttggcgaattccctggtccacgagtgcagccatttggagtggcaaaaccagttcaaacacagcttctaaaaacttaaaaaaaggacctaagacgatctgtttacgatagtctttggcatagcgtaataatccaatcataaaaacctcctgtaaaaataaaatagtcaatgaaagaaaaaatgcatcaggagaggaattctccactgtgaatttacgaataaaaaatctttcgtttctagcatatcttaccatagttccaaactgagggggagcaatcaagaaagaaaagaaagtttcatttttatttcagaaacaaacaattagttttcaatttttttgataattatacgataaatactgcgtatgatactttacttggctatgatctttttagattttttcaaggaaaaatcataggaaaattttttcgaacaaatttgcattagcataaaaattcacagcaaaaatataaaatatcttaaaaaaataggcgctgaaaacaaaatctggtacaatcggggagagtgaagtaggaaacatgaaggaggcactatggatagaaagtcgaaatttagcaaacagcgggcccgcaaagctcgtaataagcgccgaatcataggaggcgtcgtactttttgcgattgcaggagtctttttatttgcaggatatacgtattatgctgcaaaaaattctgtggataaaatgtttaaagaatccgctgtgatcaaatccaataaagaaaaagacaattcattgaaatcagcaaatgttgattctaaatttgggatcctgttaatgggggtcgacaatgatgccgaacgagaaaagaaagagcatctggatacgactcgagcagacagtttgatctatatggtctatgatggcgaaaataaaaagatcgacatggtgagtttacctcgagatatttggacaaatatctacgatggtaccggaaacgggacggtcgtcaacacggcaaaaatcaatagtgcatttgcgattggtgaggaagatgcaacgattgaaacggtgcaaaactatttgaacttgccaattgattattatgtcaatatcaattttacaagttttgagaagatcattgatgcaatcggcggtgttaccgtagatgttccttatgacattaatgaaaagtatacttcggacaattctggtaaaacactgattccaaagggccgacagtcgttgaatggagagcaagcattgatttttgctcgaatccgtaaaatggatactgacgtggaccgtggcaatcgacagcaagaagtcattgaagcagccattagtcaagcattgaaaatcaataatgtcacaaaatatcaggagattcttgactctgtcagtgacaatgtcaataccaactttaagtttgaagacttggtttcactagctgggaatatgctttctggttttactatcgataaacatacttatgaatggtatgatggtgaatcttatgatggccaatcaatcgtttatattcaagattactcctataatgagatccgtaatgatatgctaaaagcattgggtagatcagatgaaatgacaccagaaaatcaagggacgactacggagacaagtaccaactattaatgaaatgatgttcttttataataggaaataataaaaaaagaaacgctgcggcgtttcttttttttgtccccgtaagagcgcttgtaaggggccgtatacattaaatgcatgaatgtttgagtagtgtgctgcttttttctttcgctcgaaattgattgattttcttcaaaaaatagacactattcaatttttctaatgaaattcttagaaaaaaatatctgaatgattatgagctagaggagaaaaaaatgggtaaaaaaagaggataaaagcgattattcattacggatgaataatgccaattttttggcattggaaatgataactgaaccacaatgtaagcgtttttaactcgttatcatatacatgtacctgataaataattgttatttatcaggaagaagagtgattgatttcagctgaaaaaatcaataaataaaaggaaagaggcgagagagtatttcatttagctagattggttttaatgctttttgtgattttttttgcaagtgggatttatgcaagttactacacaatactaaagaaagttggagaacaatggaaaagaaaagaggaatcagtaaaatcggcttgattgccttagtagtcagttcatccattggtagtggaatcttcggtatcacgaatgacttagcgatgtccgctgctcctggacctgcaatcatcgcctggatcatcgtcggaattggcattcttgcattagttttatcattgaataatttaggcgccaaacgaccagatttagacggcggtatttttgggtatgcagaagcggcatttgggaaattaggaggttttatcagtggctggggctattggctctctgcctggctgggaaacgtcgcctttgcgacaatgctcatgagtgcaattggtgaatttatacccgcattcaagggaggacaaaacattccgtcaatcttactagcaagtgtttttatttgggtattgacctttctggtgaataacggaattgagagcgcttcatttatcaacacaattgttacgatctgtaaattagttcctttgtttttatttatggttatcgcactggttagttttcatgtcgatattttctcagcagatttctggggaaatgtcagcagctcactacaaagtggtgcttctgtcagtctctggtcacagatcaaaggttgtctaatggtgatgatgtgggtctttgttgggattgaaggggcaagtgttttagccaatcgtgcggaaaaacggtcggatgcccaaaaagcatcagtcatcggtttgctttccttgctagtcatctatgtgctagcttccttattgccatacggcgtcatgtcgcaagctgaattgatggcgttaccacaaccagcaatggccaacattttgcgctatatggttggagagtggggtgcagcctttatcaatatcggtctgatcatttccatcattggttgctggctgtcatggacgatgttaccagtagaaacaaccttattgatgtcccgcgatgggatgctgccaaaaagttggggcaaggtcaatcgaaaacaagcaccaagttattcattgtttatcactgctgcattgacgaacgtgttcttgttaacgttccttgtgaccgattacgcgtatcaatttgcttattcaatgtgtaccgcagcgattttgatttgttacttgctcgtggggatctatcaaatgatttattcctatcagcaaaaagacaataaacaattgtttattggtgcagtcgcaacggcctttcagattattgggatcacattagcaggctttgcctatgttctcttatgcagcatcgcctatttaccaggattctatttctacttacgggcatgtaaagagaacaactatcaaatcagcaataggcaaaaaatggtcatggctgtggtcagtttagcagcagtattgtcgatcgtagcaatcgctactggaatgatctcagtataagggggttgattatggatattgctaattttggtgtcgaggaatggttgaatatctgggagaaaaaagcaacctatgacattgcccaaagttctatcgaagcactgacgctagaggaaatcatggccttcagtggcaaaacgagtacagattttttgaaacgtgtcgcgcagcagcctttagattatggctggatcgaaggatcggatcgattcaaagaactcgtcgcttcattataccaacacatgacaccagcgaatattttacagacaaacggagctacaggagcaaatttcctggcactattcgctttgatcgaaagcggggatcatgttgtctccatgcggccaacgtatcagcaactctatgatttgccaaaagcatttggggcagaagtagactttgttgaattaaatcaagcaaactggcagcttgatctagcagttttgaaagccaaagtgaaacctgaaacaaaaatgatctgcttaaataacgcgaataaccccaccggtacgctatttgatcaagagcaattacagcagattgtcgccatcgctaaagaagcggatgcctacattttagtagacgaagtctatgcaccattaacagaagaaggcacattttgttccatcgtcgattgctatgagaagggaattgctaccaactctttgtcaaaaacctactcaacgccaggcattcgtatcggttggactgccgctagtgaagaactcacggaacattttcgtaaataccgagattatacgatgatttgtggcggtgttatcgctgatgaaatagcgattcaagtattggaaaacaaagagcagattatcgcacgaaacaagaaaatggtcgcagagaatcttgccattgtcaagcagtgggtagaccaagaaccgaaagtggaattaatcgttccccattatgtttctacggcatttatcaagttgaagatccaacaagaggactatcaattctgtgtggatctattagaagaaactggggtcttgcttgttccgggaacagcttttggggtaccagggcacgcccgcttaggttattgctgtaagaaagagacgctagaaactggtttgagattactctcagactatttaaaaaaagtttcatagaaaaagggaaacaaattgtataggaatgaggaggatgaaaaaatgaatgaacctattcacgttttttcagagattggacgattaaaacaagtgatgcttcatcgtccaggaaaagaattggaaaatttaatgccggattatttggaacaattgctgtttgatgatattccttttttacagcaagcgcaaaaagaacatgatttctttgccgaaacattgcgaaataaaggggttgatgtgctttatttggaagatttagcagctgaatctttgacctctacaggactcaaggaacaatttgttgcagaatacttgcaggaagcaaacatccaaagtgaaaacacccgcaaagtgattgaagaatatttactatcgatctctgataatcgtgaactgatcgaccgaacgatggcaggattgagaaaaaatgaaatgaagatcgctggccatcagaatctgaccgatcttgtagacgatcagtatccgtttctgatcgatccaatgccgaacttgtactttacccgcgatccatttgctacgatcggaaatagtgtttccttgaaccgaatgtattcagaaacgagacgaagagaaacattgtacggcaagtatatctttaactatcatccaattttcaaaaaagaagccgagcatcttttatacaatcgggatgaatccacacgaatcgaaggtggcgatgaattagtcttgtcatcaaaagtgttagctgttgggatttcgcaacgtacagatgtcgcttcaattgaaaaattggcgaaaaaattatttgagaaagaaccgacttttgaacatgtgctagctttcaatatcggtgaagagcgtaaattcatgcatttggatacggtctttacaatggtggattatgacaagttcactatccatccggaaatcgaaggcgagttaacggtttattccatctccaaacaaaatgaccaaatcaaaatctatgaagaaaaagaaacattggaacggattctttgccgctatcttgatttagatgcagtggaactcattcgttgcggaggtggagatatcacagcagctgccagagaacaatggaatgatggttcgaacacgttgacgattgcaccaggagaagtagtcgtctatgaccggaacttgattacgaatgaaaaactagtcgaagcaggggtcaaacttaattacatcccaggaagtgaactcgttcgcggacgtggcggccctcgttgtatgagcatgccatttatcagagaagatctttgagcaacctgaaatttacaaaaataaagactaacggtatcataggaggaatgaataatggaacaagtatttcaaggaagaagtttattagcagaaaaagattttacgaaagaagaaatcgagtatctgattgacttttcgattcacttaaaagggctcaagaaaaaaaatatcccgcaccgctatttagaaggaaaaaatattgccttgctctttgaaaaaacatcgactcgtacacgggcggcctttacgacagctgccatcgatctaggtgctcacccagaattcttgggcgccaatgacattcagctaggtaaaaaagaatctgttgaagacaccgcgaaagtgttaggcagtatgtttgacggaatcgaattccgcggcttcagccagcaagtcgtcgaagatttagcgaagtattctggtgttcctgtatggaacggattaacagatgaatggcatccaacccaaatgatcgctgatttcatgacgatcaaagagaactttggcacgttgaaagacatcacgttggtgtatgtgggagatggccgtaacaatatggcgaatagcttgttagttactggtgcgattcttggggtcaatgttcgaatctgcgcacctaaatccttattcccagaagacgatgtcgttcgttatgccaatgaatttgccaaagaatctggcagccaattgatgatcacagatgacactgctgaaggtgttcgtggtgcgaatgtcctttatacggacgtgtgggtatcaatgggtgaagaagacaagttcaccgaacgggtcaatttgctaaaagactatcaaatcaatatggatttgatcaaagcgacaggtacaccagacgaccgcttgattgttttacattgcttgcctgccttccatgatacgaatactgtctacggaaagaaaatcgaagaagaattcgggatcaaagaaatggagatcactgatgaagtcttccgcagcaaatatggccgtcaatttgaagaggctgaaaatcggatgcattcgatcaaagcaatcatggccgctactttaggaaatctatttattccaagagtgtgagaggacgagggataccatgacgaataaaagaacagtagtcatcgcattaggtggaaatgcgatcttgaccgatgatcctagcgcaagagggcagcaacaggcgcttagacaaacagccaaacatttagtatctttgatcaaacaagagatccaagtagtgatcacccatggaaatggaccgcaagttgggaatctcttattacagcaacaagcagcaaactctcccaaaaatcctgcgatgccattagatacctgtgtggctatgactcagggaagtatcggttattggttgcagaatgcattagaagaagaattagcagcagaaggcttaccaacaaaggtagcaacgctggtcactcaagtagtagtcagtgaaaaggatccagcatttgccgatccgacaaaaccagtaggacctttcttgactgaagagcaagcccagcagatgatgacagaaaccaatgcgatctttaaagaagatgccggtcgcggttggcgcaaagtcgttgccagcccgaaaccgatcacaatccatgaccaagccagcattcgtgcattggtcgacaacgattttattgtcatttgtgcaggtggcggagggatacccgttactgaatcaggacaaggagtcgaagccgtgatcgacaaagattttgcttcagaaaaactggcagaggtcttggaggctgaagagttgattattttgacaggtgtctctaaaattgccttaaactatggaaaagacaatgagcaatggttagaccaagtcaatttgacagaactggaacaatacatccaggaaggtcactttgcgccaggaagtatgttgccaaaagttcaagcagcgatggattttgtgcaggttagcaaaaacaatgttgcgatcattacctcgttagaagatctagctgattttgatcacgaaacagggactcgtatcatttctgattaactggcaaacaaagtattggagtgatggatattagtggaaacatgcgagaatacgtaaaagacaattttgattgtctaaaagtgctgacgcaagaaaacagggaacgattggaagaaaatatgtattaccgaacctttcctaaagggcagattctattcaacgatggagatttgcgtgatcgtatttttgttctatgtagcggactgattcgtatcgaaaaaaatgatcaaaccgattctttcttttatacggatttcatcagtgaaggtgaactgtttccggtaaatggcctttttgaagcagcgtgttatgacttttctgccattgcggtgacagagatcgaagtcgcgtatgtggcaactgctgttttggaacaattgatggtagcggatcgagaattattgaaaatgatcgttaagaaacaaggtcgagtactggaacagcaagtgaccagaatgcaatactgtattacttccagtgcccatgatcgtgtcatcaatacactagcgatccttatgaaaaagcatggaaagctagatgagtcttggtatattccttatccgatcatgatcaacgatcttgcgaaattcagcggtacgacgagagaaacggttagtcaagtgctgaaacaattgatcaatcagaaaaaaatttcctaccaatataaagaattgatatttatcgatgatgcgtttttccaattagatgaataataaaagcactgtgacgacaatcattaaagggtgggatcgattttccaaacaactactgtggcaagcagctgatttacggatgatcgatctcgcttacttttaaatgactcgagtgtccatcagtgataattttttgaatgcggatacatgacgtatccgcagataatggatagagtagaagcaggtgatcattttgaagaaaaaccagcgacaagcgattatcaagcgtttgatcctcaaccaagaagtagagacacaagaagaattgatgcgcttattgaacgaacaaggcgtgtgttccacacaagcgaccatttcaagagatatgcgggagttgaatatcgcaaaaacttatacgaaagaaggcaaaacgaagtatacgatgattgctacggcggaagcagatgtgaccgaaaagctgaagctatcgatgaatgaatacttgaaatcaattgaacaagtggagttcatcacagtgatccatactgtcagcaatggggcagatgttattgcgaattatctagatgaaatggatcttgaagggattgttgccacgatggctggctttgatgtattattgattctctcgccatctaaagagcaagccacacagttgattcatcatttagaaaaatatatcgactagcggcgacgatgcccatcaccaatgcttgaccaccattgcctctcggcacgaacaagcatggaacaaatgaatacagaatcaaccagagacaaaaaagcaacgcgattcactcggaacgacaagccagagaatgacagttactgtcgcaatcctctcacttgtagccagctttcgaaggagaatgcaacgctcacttgtctctttttttgtattaaaaaagttaaattctatttctgggtctcgtcagcgctaagcgcaattgttttcctcctctattggaaggtgctattcttaaataagcagaaggaaacacttgataaaagtggacagaacggagacatagaaaatgaaagaggccgatcaagaaaaacgacaggcacgagggattgtcttagtcacgcatattattgcagcagtggtcaaaatcattggatttcttttcagcggcagtgcggtgttgatgaatgaaagtattcatagtgtcattgattgtctcaatcagggattactagcaatcggcgaaaaacgagcacggcgcggccgaagtgaactttaccaatttggtgaggggcgcgcgacgtatttttttagtacggttgtggcaatgacggtctttttcggtggcggcctgttggcaatcatggaggcaagtcaggatcttttggatcctacccacgaagtggagaacatccaactagttgcagccattctttttgctggtttttttattgaaagttcagcagtccaaagtggaaggcaagaaatcaaagagcaaaacacggataaacagccgttgatcgcttttttgaaagaaagccgagagagcgagatccttttaggctttacagaagacttgtttgcattgatcagtgtgagcattgcattggtgggtattttattgacagcaatcaccaacaaccccatctttgattctttagggggcgtcattggtggggtccttctagtgatcgtagctggttttttagggaaagaattttatagtttattgatcggagagagtgcttcgaaaagtgatctaaaaaaaattcgtcaagtattatcatctagggaagtagctgaagtgattgacctgcgtactctgcatttaggtccagatgaattactgatcgttgctgaattgacgatttctcctaaagcaacttcgagtgactatgaggtgatcgatcaattggaacaagaaattcgcacggtattagctccgaaaaaaacatatatttacttagagacagaaagacagcagcaagaacaggtaaaaaaaccgattccatgaggggaagaagacctcaaaggaattggtttttttactaagcagtggttagttttcctctagatgataaatatctggggttaaatgatcttctgctactctcaaacccgttcatagtatttcaaatgaatacttgcggcaagctgatttcttcaagaggatcacttctttttctgggttgacttggattgaattgggttgacttaaaacgaataaattcaggtggaaaagcgcgagcgaaagaaatttcttattaaaaaaagttgttattttttatttatttcacaaggaaagggattgctctatcagatttatttgtgaaaagaaatcggaaatcttgattctctttattttaaattcaaatttacataaattttgttctttatcttaatgatattgatatttttcaagcaaaataatttacctgtcttttaatccatgataacttaaagatggaaagatggttttttcacaaagtaaacatccttatctgcagacacccttttacgaagtacccagatctccctttctaaaaccaatgattttcaattgctgtgttccaatcaactcgtaaaaaacttgtggaggcgttttcccatctgtattcgcattcgatcaagattacagacaccctcacaacatacgaaagaagcaatccttgcttgatttttccgttttgtcaatcatacgccctgactccaagcacaagtgacacaactttacttgaagccataatttgtcatggacaaaatctcactataaaaacagagctatagacatagaagatacttatacaaggaggagaatagatggaaaatttttatcagcgaacaccaacagaaacacttgaatactttcattcagatcagacgaaagggcttagtaagcaaggcgcaaaagaggcgctagatacctatggtgaaaatacgattcagcaacaagaatcgacctccccttggaaattgttatggcacaatttaaataatctgatcgtttatttattactagccgccgcattgctctcttttgcgatgggagaaacgatagaaggaattgctgtgttgattgcggtggtaattgccgtgatgactggttttgtgacagagttgcgtgcacagaagtcaattgattcccttcaggaaatgatttacactaccgcaaaagtgattcgtgatgggcaagtgatggaagtcgaatctgctgcgatcgttccaggggatattctcgttttggcagaaggtgatgcgatcgctgccgatgcacgtttgctggaaagccgcaatttagcctgtattgagtccgcattgacgggcgagtccgaagctgtcgaaaaaaatgcggcagaacaatatgatgaagacgtccctttaggtgatcgccgcaatgttgtttttgcaggaacagcagtgacaagaggaaatggctatgccgtcgttacagccaccgggatgaaaacggaagtcggaaaaatcagcgatatgctgactggaaacaaaagcgcgaaaacgcctttggatatcgagctggataaattagggaaagctatcattattgcggcactctttgccgccgtgacggtcctaattgcaggtcttctaacggatcagcctttggtagaaatgctgcatatctcgattatccttgcagtagcagccattccagaagcaatgcccgctgtctcaaccattactctttctcgcggcatgcggatcatggctgaacacaaagcattagtcaaaaccctctcagcggttgagactttgggcgctacgagtatcattgccagtgataaaaccgggacattgacagaaaatcagatgacgatcgctgagatcattctaagtaatggagagcaatacactgtgaccggtaatgggtacgaaccgacggggagcttccataaagaaggacaagaaatctcagttaatgaagagccagcacttcaagcgatgattgaaaacggtgcactatgtacgtccgcttctttgaaagaaacggatggccagtttgaggtcctaggagatccaaccgatggagcgtttgttgtattaggaaaaaaagaaggcatcgatcgtcaaacactgatggatcaaggcattgaaaaaatcgctgagcttccttttgactcagaaaacaaatttatgatcaccgtctatgaaaaagaacagcgaacgttgatcatgaaaggtgcaccggatgttttgatcgagaaagctgccgtcgatccgtctgtgaaagagcagttgaacgacatcaatcatacactagcttccaatgggcaacgagtgattgcggtggcacaaatcagtaactatcagggtggtttgtcggagtctgagctgacagaatcattggataatttagagatccaaggttttgttggcatcattgatcccccacgaacagatgttaaagaagctgtcaaagtcgctcaagaagcggggattcgtgtcaaaatgatcacaggtgatcacccgcaaactgcctccatgatcgcacaagaaattggtttgatcgattttgataagacgatgacgggaaaagagatcgacgccttggcaggtaaagaagcgtttaatgaacggatcgaagaagtggctgtatttgctcgggtttcgccggaaaataaacttcaactagtcaaagcactgcgggaagaaggagagatcgtgtcgatgaccggtgatggcgtgaatgacgctcctgctcttaatggtgccgatattgggatcgcgatgggcattcgcggcacggaagtagctaaggaatcttctgatatgatcttgactgatgatcgctttgggacgatcgtcgacgcaatcaaagaaggaagaatcatctttgacaatatcaaaaaatacgtttctttccttttttcttgtaatatggtcgaaatcgtgacaatctttctaagtgtcatttttcttcttcccatgccgattcaaccgctgcatattttgttcttgaatctagtgatcgatatcgctcctgcgatggcgttggcctttgaacctgcagaagaggacctgatgaaacgtcagcctcgttccaaagaagacagtttggtcaataaacgattcttaggtcgaattattttaagcgggatagtgatcggattgacggcatttggtttttttagttttttgatacaaacaaatcatgaattagcttatgcccagaccgctacgtttacctttatggcgatcgcacaactgatgcatatttttaatgttcgcaagcaaagcggatttggattagacaagtctttcttcaagaataaaccgttgatcggcgcactgatcctttcgatgggattgcagttgtcagctgtttatctccctttcatgaatgaattattagggacttcaccattgcaagttggcacatggggaatcattttcttagcggctagtctttccacactggttgtaatgggattaaaaaaagcctttcagttgaagtgaaaaaaacagcaagaaaaccaacgatgatgttggtttttttgtttgctttttgtctatcgcaggaaattatttacaaaagtaagaaaaaaagttattattgacgagtcaacgattgatgagtcaattgttagagaggagtattccatgcagctaagagaaatcagccgcctgctttatcagttgaaaattgccaatcaagaattgacgacaacttttgaaaaaagcaccgggttcagtctgacccgatatgaattaatgatgttcatcaaagaaaatggacgttgttcgcaatctgacttacagactgaattgaagatcgatagtgcagcagttacaagacatctaaaaattttagaacaaaagaattatgtagtgcgggaaaggaacaaagacaacaatcgtgaagtctttgtggaaataacacctaaagccaaacaagagctgtctgcttgcgagaaacaccaagagaaggaagcattcgccctatcgctgaccgaagaagaagcagctgcgtttttgcagttgttgaataaattaatgaaatgaaagaggctactaatatgtcaaccaatagagtaaacaacgatttttcagctatcacttttggaagaaaatccgtccgtgtctatgatgagacggtcaaaatctctcatgaggaaatgttaacgatgattcaagaagcaacgactgccccctcatctgttaacatgcaaccatggcgtttcgttgttgttgaaagtgctgagcaaaaagcaaaactaaaaccactgatccgcttcaacacacgccaaaacgacacatcggcagccatgatcttgatttttggtgatttagcttgttatgaatacggggaagaaatttacaatcaagcagttgaagcaggaaaaatgccggcagacgtcagagaccaacaattggctacgatcattccttactacaagagcttcacgaaagatcaaatgacctccatcgtaaaagttgacgccagcttagcggcaatgcagctgatgttagtcgcgcgtgcccatggctacgaaacgaatccaattggtggctttgaagcagaccaattagcagaggcttttgatgtcgatccagaacgctacgttccagttatgattctatcaattggtaaagctgaagaattaggctatgaatccattcgtttggatgcagaaaaaatcacgacatttaaataaatctactcttactttctatgtggtcttccgtttgtctttgtgttcgctagaagcatgaaggacggaagattgcttggtttactttataataaagaaaaccagatttaaaaaaggaggaagcaaaatgtccactattactataggtttaatcatgttcgttgcacttgaatttctatttatcatgtatttggaaacttttgcgactacttcaaagagaacgcaacgggttttcaatttatcaaaagaagaattagaacgcccttcactgaatacattgttcaaaaatcaaggaatctataatgggttaatcggcatcggcttgctctatagcgtgtttctttccgcttctcctgtcgaattgagtcgcctgcttttgatttatatcattttagttgctctgtatggcagcatcactagtgacaaaaaaattatattgacacaaggcggtttagcaatccttgcattgatagcaacttttttctgatttttgaaagataatcaaaatgacctctcacagttacgtgttccattaaatgatggaaccgttgctagtgagaggtttttttgttgatttcatttgttaaatgagaggacaagtttgcacttgtcgtaaaaaatgataggataaagctaacgatacaaacctaaaagaatcggacttttactcagcggttttctggacgtaaactggtggctgcgaaaagcgctttgactaatattggtgtcaggatcactgctgtgatcacttcagaaacgccgttagtcactgcaatagctcctaatgtgacaaacaaagcagaagcatcaacaccataggtagtggccaccaaactagtgtacagggttcccatcaacgttaacacgagaaccgtgttggtaagggtaccaaagatggctgcaacaattgaagcaaggacgactttctttgttttacgatagagccaagtaaacaatataccagcgacgagacctactaagacccttggcaggactgagatgatcggattagtgaatactgtgatatccaaaggggtcgtaggggaagtgaatgcccgaataatcgtgaaaatcccccaaaccaagccgataaacatcccatctttcgttcctaaaacaatggcagcaacaatgaccgtgatatgaatgatcgtcagactagtgatgccgataggaataaagccaaggaaaggcaccatcgtttgtaaaataatgattgcggttagaattgcacggatcactaaacgatacgttttgttttttgtgttcatgagaaaacaccctttcttatagaatgacactcgtgtcatttttatgttaggatgattatacaataaaatgacacaggtgtcattaataaagtgaggtggaagcatgaaaaagccgatcgaagaaaaaaaacggcaaaaacgagaagcgattttggaaagtgccaaagtagtattcagcaagaaaggattgatcgatgcgacgatgcaagacatcatcgaagaatgcggcatcagtcgcggcgggatctatctgtactttcaatcggtggatgcgattttcttagaagtgctgcaacaacgttcgcaacgacggtttaatgaagttcgagcaatgatcaaagcaaatgcttctttcgagactatcttgacgaaatattttgaggatcataaataccgattgcttcatagcatatccgacagcatgctgcgagcgacgtatgagtattattatacgcataagtcaattgagacgagttcgttgcagcaaacgcagttgactgagacgaaacgcacgatccaagagatttttcaagttggggtcgcgcaaggtgtgattgccgatcggaatctggaagcaatcgcggaaaactatatgtttgttatagaaggtctgggtattttagctttgacgggtcatattcaagaagaacaaatcgatcatcaaattcaagtgatgcgaacactgttgccgtaccaataaaagtttttagaagctgtgatagaagataatacaaaaaatggagaaatagcctttctcaagttcgattgagatcgaacgatctctggacttttttgtagtgaattcttttgttacggcttttttttacggctttttttctacggctttgtaatctttttgaaatcaagaacggtttgtatcttacagatactgcttgatttcataaactcatcaacttagatgtcttttcgaaaagtgatcataatggaaggttgagtgttttttaagaaactatcgagaattaaaaaacaagtgatttcacttgtaatgaaaatgtaaacgggaaatcaattgggttgtgaataggagtatgttaaaatgataaatgtcaaataaatgtaatttgatgattgaaattgacgaattggaggagaaaatgaaaaagaaacttgcatcatctttgtgcatttgtgcaatagcgctgacaagtcctgtcatcccaaccgccgtgttcgccgatgattacgatcaattgattcagcaaaaaaataacgaagtagctgaattgaaacaacagcatcaatcggtgcagacacaaatagatcagttaacaaatgaagtgtctgacatcaatgaacaagcagctgaattaatcgctcagcagaaaaaactagggaatgaaatcaatgatttagaaaaagagttgactgatttggaagcacggatcgagaaactacaagtagcgatccagaatcaagcacgagacactcaagtcaatgggaaaagtgatcgctttatttccgtgcttttggattccgaatctttcggtgactttgttcagcggttccacggaatgacgacgatcgtcaatgccaataatcagatgatccaacagcaacaagcggaccaagcagctgttaagaaaaagaaaaatgaagcagaaaccaaaatggcggaaatgcagcaaatgcaaggccagctggaagcccaaaaaggaagctggcgtccaagcaagcagatctgaatgtcttgcagacaaacctttctttacggcaagcaaataaagaaagtgaaaaggaagcattgctcgctcaaaaagaagcctatgaggcagaacaaactcgaataagagaagaatcagagcgggtcgcagcaagacagcaggcagcagctgaagatcagctcataccaacgactaccgagtcttctgaaaattcttcgatttctgaagctgattcttctgaaaccgaacgttctgctcaaggagaatccactgatgttcaaggggatatccaagaaacaccaacaaataatgaaacaagccccgtaactactccagattcttcttcgaaggcagcaagtacggaaagcagcagaaatcctgctcctcagcctgctcctagctctgagcctgcacctccgacaccatctgcgccaattgggaacgttggagctgcgatcgtagcagaagcttacaatcatctcaataagccgtatgtctggggagcaaaaggaccagatagttttgactgttcaggatttacccgttatgtctatttacaagtaaccggaaaagatatcggtggctggacagtaccgcaagaaactgctggtacaatgatttctgttagtcaagcgcaagctggtgacttactgttctggggtgctgccggcagtacccaccatgaagccatctctttaggaggcaaccagtacattcatgcccctcgtccaggacagacagtttctgtggggaatacagcatactacactccgagctttgcagttagagtcaattaattattttatctttataaacacttgatccagtggactgattctcattgaacccaatgggcagaatgaatcagcgctagtagaaggagagaaaaatgaaaagcagaaaacagatccacaaagagttgcaacggcaaaaacgcagtcaattgtaccgaaaaggagcagctaccactaccgctctcgttagttcgctgaatttagtaccggttagtgtgctcgcaacttctgttgaagaatcgaatgacacgggtgtacaagtggttgaacagtctacggtagcttcgtcggatgatacagccgatttacacgatttagtaaatgaatcacaagcgagtcaagcaacaaccaccgaggatactggaaccgaaacatcgttgactgaggacacagattccacagtatcatcaaatgagtcagcaaccagcgagtcttcagaagaacctctaggaacggagcctgccagtgacgttgattctgcagaatcgtcaagtgagatcccaatgttgtcagaggcagagcgaattgcattagaaacaaagattatgcctaatatcgatcgtgtgatggcaagatctaatacacaacaagccttcatccagcaagtaggaccaatggcgcaacaagtagcaagtgtcaacgatctttatgcctccgtcatgatagcacaagcgatccttgaatcaggatggggacaatccacacttacgacgcaagcaaacaatatgtttgggatcaaaggttcatacaatggtcaatatgttgagatgcgaacaatggaagatgatggcaacggcaatctttatgagatcgttgcaaaattccgcaaatatccgtctttaaaggaatcatttgaagataatgcccatgtcttaaaaacgacttctttttcaccaggcgtttatttttacagtggggcttggaaatccaatacctcttcctatcgtgatgccacacaatggcttcaaggaaggtatgcgacagatacgacttatgccggcaagctgaataatttgatcgaaacctacaatttgacacaatttgattccgcgaccggtggcggcagcgggaatggcaacaacaccaataattcagaacaaacgatcaataagcaattcaagaccatggcagcgctgaatattcgttcagatgcttcaaccagtgccagtgtagtggggtcattagccaataatacgaccttcaaagcagtggcccaaaaacaaggaaccagtgttaatggcaacagtacttggtatcgggtggaaggcaaaggctgggtcagcgctgcgtatgtgatggaagtaggatccaacaataacagcaataattcagagcaaaccatcaacaagcaattcaagaccacggcagttttgaatatccgttccaatccatcaactagtgctagtgtcgtagggtcattagcgaacaatgcgacttttaaggcagtagcccaaaaacaaggaaccagtgttaatggcaatagtacctggtatcgggtggaaggcaaaggctgggtcagcgccgcgtatgttactgaggcagggtccaacaataacagcaataattcagagcaaaccatcaacaagcaattcaagaccacggcagcgctgaatattcgttcagatgcttcaaccagtgctagtgtcgtagggtcattagccaacaatgcgacttttaaggcagtggcccaaaaacaaggaaccagtgttaatggcaatagtacctggtatcgggtggaaggcaaaggctgggtcagtggtgcctatgtgaaagaagtcagcagtacctctagttctaagacatataccgtaaaatcaggagataccttatgggggattgcacagagctatggggtctcaatcaatcagctgatgcaatggaacaatatcagcggctcattgatttttatgggacaacgattgatcgtcagcaaatgaccctaataataggcaatagatagaaacattaagatgaaagtacaatgatgaaggcacaagagggcaatactcgaatagctgccagataaaagaaatatgagaaaaaatcggatgtaaaaaatttccaaacgaaggaaggagaccgcacaatttttgtgttgatctccttctttcgtttgagtttaaagcaacggctgttctgcaatcatgcctttattgagggctctcttggaaactatccatgatctttgttagttcatcttttgaggaatcaaaaagacttgctaaggtccaaccatataattgaacataattattgtcggtttctgttacataatataagtaatgtatgttcaacccttctacagttgcagcaaaatcaaccatttgggtttgagtaccaggaaccggtaaaaatgtcgcgttggtaccaaaattcgatgctaaactgtcttgaaccaatgcaagataactgtcgaaatctgcaaagtcttgtttagactccacaacagccgccagaaattttgtttgtaacgaatcagaaagcataaaatcattatctggatttagtgactcaaaatcggctacagtttgccaatttgtcggcagttccagcgaataggaataaccgcttacaccagtgatcgtctgcttctcaacaggaatcacattttctgaagtgccagtgctggctgtttcagaagatcctacagtggaagaaaattgtgtacgctctttttcttttgtggaagaatcaaccaatcccgatggtttttctgtacatcctgctaaaaataacccaaacccaactaaacctaaaaccatgtgctttttcatttttttactccttctagtttttttaaaaaacttattttatttatcctataataagctcgtaaataaggcaatagaagaatctttctaaatgagcactattgaaagtagtttatcgaattttaaaaattcaagtttcgtttatctgctggctaagtctggatagtataggagattgtacacatttttccttacatgatgcaaaaattgattataaaacccacaaatcatttgctatgctatataaaaagtgaatgcatccctcgctgctcaggatgattattgtcggaaaggtacacttgtgctgtcattggcaatcagaactttttgttagctgtcgattatccattgatagtctcctaagcagggaaatgctagaaaacagaggtgagtggatgttttatccagatgtcaaagagtatttgcgaaagatgcgtgggaatattgattttgcagtgatgaaggaacgtctgccattggtccatagttactggcaagtgacggaagcagaagtagaaagaattgttcgcgaagaatctgaggaagatttctggacaagtgtacaacaaatcatcttactcgatgccaaattggtccttttgcgaagctatatcagcgaatttgatttccaaggtttttcagaggaagaaatcatcgagaatatcgaactagatcatagcacctatacaaaagaattgtgcggttacaatttaacagatacaggacatccctcgatcctttttggaaagggcagatgactcgatcagattaacgcaaatcttttctttaacgacaaacgaagcgtatactggaataagaaagaaaagttttctactattatattgctcttttataatgcttttccaaaaaagttatttaccattcgttaggagagatttccatgactgaatttactcagatcgttttgctgtttttcttgtattcttttgtggggtggctgtgggaaacggtttactgctcgataaaagccagacattttgtttatcgaggatttttggtaggaccgatcactcctatttatggctttggaattttaggtgtcttgtatttactgcgaccgttacataaccaattgctgctgctcttttttgcagcagctgttttagtgaccttattagagtacgtgacgagctttttattagaaaaactgtttcatgcttcatggtgggattaccacaatgtttttttgaatatcaatggtcgcgtggctgtcccaatttcaatcttttggggcatttgctgtgtcttgatcgtccgcattgttcatccgcaaatgttgatcattgtccaaatgttggctgaaagattcagtttttatctacctgttggattgttgatggcgatgtcgttggatatgggctatacattggctaatcttgctgcttttcaacgaacggttcaacgactggaccgtgctattgaacagcagaaagccactttatcagaaagtttggaacaaaagaaaaacaattggcaggaacgtatttctgaactgccaatcgattggcagcaattgcgtgaaacgttaccgaagctgaattttcatcagcgaagacttttaaaaaactttcaaaaactgcaaatcaatgagattgccaatgttcaagacttacggcggtttgtggaagaattacgtaagaagagagagtaatattacaaaagtattacaataaaaaaagccttttcaaggctctgatttcccactttcacgtgaattattttttaatagactcttatttctcccactttggctaaaaattgtaataaattgtaaaagagttgcaatatatcttgcccccagaatttgtataataataagcgttggaaaccttagtgagaagtgagggaatttttttgaaggcaaagaaattacgtaccatggtcgtcgcagtctttgcggcaggtatcgtttcgccgatctttgcgcaggctgaatctctggaatcattgaaagagaaagaaagtgccgttatgcagcaaagtcagcaaatcagtacagaagtacaaatcgctttgaccgatgtcaataataaatacagcgaggttgaagcattaaaagcacaaatcgctaacaatgaagaaacgttggcacaaaccaaagaagaaataaaggcaactcaagaaacgattgaaaaacgtgaagctgtagttgcagaacgaatgaaagacattcaagtcaacggtggagtaaccagagattggacagtcttgttggaatcttccaatatccaagatttcatcaaccgggcttacgccatgacaatgctccaaaatctagaaaaagaaaaaatcgactcgttgacatctgaaaaagaaaaattagagtctctgcaagaaaaagccgagtctaccaaagaatccttacagcaggatcaatcctctttggaagcacaggcgcaagagttggatagtaagatcgccaacttgcagacacagttgaaagaaaacgaatcgaccttagcaaagattgcttccagcaaagaagcagaagaagctcggatagctgctgaaaaagcagctaaagaaagagcagccaaagaagcggccgaacaagaagctaaagaaaaagaagcgaaggcagcggcaaaagcagcgagtgaaagctcaagtcaagagtcgtcatcttcaagtgagagcgcgcaatcaaacagcagttcaagcagcaattcagcttcaagcaatacgagcagcagttcgacgaataatagttcaaacaactcgaataacagctccaacaattcgggtagcaacacaccttccagcggcaagacaatgatcatggaatcaaccgcatattcttatgcagagaaaggtgctagccacctgactgccagcggaacagatcttcgcagcaatccaatggcggtcgcagtcgatccaagtgtgatcccattaggtaccttggtgaatgttgaaggatatggcgtggcgctagcgctagatacaggaggcgcgatcaaaggaaatatcattgatgtccactttgataatgtagccaaatgtctgcaatggggccgacgtcaagtaaaagtaacgattctagactaataaacgaaaaagcgtatcttgtaatcctaccatcattcatgattgatggtggacaagatacgcttttttatttagtgggtaaaagcatcatctagaaaagctcgtttcattcctgcagctgtgcctgcatcgttttcaatgtttggatggaatcgtacatttgttgttgctcggactcattgagaggcatttcaataatttcgcgaatgccttgactattgacgattgcaggggaactaatacagacatcggttgcttgatactgtccctctaagtgtacagaaaccggcagtactgcatgttcatcttttaaaatactgcgggtgatcctagccagcgagattgctatcccataatgtgtcgaacctttggcagcaatgatgtcataagcggcatttttcactttttctgcaatcaggccgagatcttgctccgaaaaacttgggtgtttttccagccactcgtgaacacttaagccaccaatattgccatgggaccagactggaaattgggtatcaccatgttcccctaagacgtaaatctgaatatcccgtggatcaatggtcaactgctcgccaatcgcattacgcaagcgcgcactatcaagcgcgcactatcgagagaagttccagaaccaatcactttgtgagcgggaaagccagtgatttttttgacatagtgagtcaaaacatctactggattactagcaatcaagaagatcccttgaaaaccgctagcaataacagatttcacgatctttttcatgatctgagcattctttttcgtcaaatccagtcgtgtttcatggggcagctgtgctgcaccagcggtgatcactacaagatctgcatctcgacaatcctcataatcagcaacgtatagtgtttttggaccaacatatgccaagccatgatttaaatcctgaatgtcacccgctgcttttgccttatctaaatcaataataccaatttcattgccaatcccttgagcgactaatgcaaaactgtaactcgaacctacatccccatttccgatcagaatgattttctccatgaaagatcctcccaaatttgattcgacttaaatacacctaaactgtatcaaagaaccagaaaaaagagtattgatacgttctcagtggcgttgctgtcttataattagggaagcaatagacgcttaagagcacttcccctgtcataatcggaagtgctcttaagcattcatatgaggattgagacatttggctagcttattccagtcatttttgtcagggaaagttttaaaaatcaaacaatcaatgtcattagcataatcggaaacatattctgtgtaatttgttaccacgagatcaatgtgattcatcattaaataatcaggtgacaattcatttgaatcaggaaagaaaaagttttttgagctatgcaagtaatgcatcgatttgctttttaaatactgacagagaatatatgagccttcaaataagaaagcaacattttttttggtatgccaataaagcgatttgatagattccaaatagatcgtcagactggcacttaaatggaataaaatctttttattccacgtagcaacagctaatggattttctgtgagaaaattccgacatttttgataagactcaggaaacaagcgctgggcgtaaagattgacatcggcaatattatgattcaacaaaggggagagcaactgtttgattttagctacggtaaaaaaagattcgatcaagatatgatcgcgggaggaatttttggtttcaggaatacaggtagctacaaaatcattggccagctgagtgatttctgcccactgattgtatttttggcagaagacttcctcaccagtaacgtcattaatcgaacgccggctccaaaccaacagaaagagatagagaatctcttcttggggaagtctttgttggtagtgttcaaagatatgctgattgatttccgcaaattctttgaaatcttctttagttgaaaacagtttgctgattttttttggtagtttcactgtgtgtcccccgcaatagcgctcaagggttatgtacaaataataattgagctctccaaatgagcaggcttgcttgttggttcgctggcagtcagaaaaagctttgacggtgatgtcgtgaatcgcaatagggggaaagatcgtgtgtgccgtgatttctgattcataataaaaatcatgaaaaaatttacggatatccatttcatcgccaatgaatgtgattgggttataatctagctgcaagtggtagtcgcgaagaacaggttgtacttttctcaagtaacgaagaaccgtactctcagagatatgatacctttctgcccattctgaagaacgcatttcttcatgctgaaaaatactctcgacaatatggaaaagaatctcgtcagtaatcagtgctcgtttcgctgcgaggtacttcgccgggttcaatacggtgaaaatataacccttgtgggacgaatcgatatggagggcatccttgaaatgggacttcatgtctgtgatatcagtcacaatcgttcgcgtcgtacttgaggaagcctttgccagtgaacgagtagagcaaagcggctctaactcaaataagtcgagaatgcgcatccaacggatcgttgcagtattcgtaacgaatttcatctgaagctctctcactggtttgctcctttcattttccaattaaagaattgaatctgtctatagctatcttaatgaagttagaatcgcaataacaaatcacgtatttcatcaaacggtgaaaaaattgacatgaattgccaataaaccattcttttgcagtcacttattggcaaaaaaccagatgaaaaagaacaaacaccttcccatttcaaagaatagaatattgaaaaataaggtggtttataaaaacagatcaaagcgagcacttaaaaatagaaaattaaatgagtaaaaaatggttttttcaactatttaaattatttaattactagattgaaaaaagactcaaaaataattgcaaacatccaagaatcctttaagaaacaaaatcgtgatttttctcgctgttcatgatgctagttttattacaagggatacaccttaacgaatgcctaaataaagatgaaaaagagaatgaaattcttttaatgaaaaaattgatcgtcagaaattaaataacaaaatatatagtttttagtgtttttttatataaaagaaatcgctgttttattcaagttaaatcacaatttttgcaaaaacattgttcttaatgatgtaaaaacttggtaaattacctttatttaatttcaattttctcttataattaactagaattgagcaaatttgcttttcttgattgaaaagataaatttataaagcacaaataatttagggagtgtgttcatgggaaagccgttacttaagactttgaccgttgtggcagtcggtgttggagccgttgccatctgtttggttggatatcgccagaacaatcagcgacaataccagcagcgggtagaatatgcgcaaaccgcgatcgccagtgagaccgacggtattgcatcgctgaaaaaagaggttgcaagcctttatcttaatgaggatcatacatttttaaaagcgggcatttccgcggatgatatcagccagctagtcggaaagctagccatgatcaaagtatctggcgaagaatacggcattgaagaggatgcattgccggcagaagccaaagagatccaaaagcagaaacaagccatcgacgatgagttgaaggatatcgaagcaaagcaaaaaatccaagaagcaaccgacaagctcttcacgaaaggcgtctccaattggcagaaagccgaaaatgacgtcatcatcaaaaaagatctgaaagagaccgacgttggcagcattcgtgaaaatttgaattttttcgaggaagacaaatggacagcattagtaaaagaatatcttggttttgcagatgcgcagcttgatcgcgtgacaaaactgcaaaaagaatttgatcgtatgcttaaagacgataaagtgacggatgcagtgacctacgagaactacttatcagccgttgacagcatcagcaaaattcgcaataaagacttgaaagaaaaatataccaagcttgcagaaaccgttgcttcacaaatgggctatgctggttattacggtaatacaacagatacggcaacgactggtgatggctattcagatagtatgacggatagttcagagacagattcagaatcctattattgataggaagagccaactggaggaataattatgtcaaaaggaaaaaagatttttttgattatttttggaatcgttgcagtgctcgtgatcggtgtggtaggaatcggcgccaagttatacatggatctatccggttcgatccaaaagacctatgaatcagtggagcgttcacaagatgaaaagaaacgggaaaatcctgttgatttaaaaaaacaagagtccttttcagttctattgatggggatcgatactggggacttgggacgtgtcgatcaaggccgttcagatacgatgatggtagcgacggttagtccagaagatcaacaaacaacgatcgttagtattgctcgggatacttatgtggacattgtcggtcatggtacgaaagacaaaatcaatcatgcctatgcatttggtggtcctgcaatgtcgatggataccgtgcaaaaatatttagatattccagtagatcattacatctcaatcaatatggccggtctgaaagaattggtagatgccgtgggaggcattgaggtcaataacgacctgacttttagtcaagacaattatgatttcacgattggaaaaatcactctagatggcgatcaagcattggcgtattcccgtatgcggcatgaagatcccaatggcgattatggccgtcaagaacgacaacgcaaaatcgttgagggaattgctaagaaagtgttgagctttgatggcgtcagcaaataccaagatatcttgagtgctgtcgaaagcaatatgaagacagatatgagttttgataatatgcggacgattgcattggattatcgggatgctttcaaaacgatcaaacaagatcaacttaaaggggaaggcttcatgcaagatggcatttcctaccaacgggttagtgaggaagaactgaatcgagttcaaacagaactgaaagaacaattaaatcttgagaatgaataagaaagtggagaagaaatggaagaaacaattagcttaaaagagatatttgaagtcttgcgaaaacacttggcttcaatcattattgccatgtttgccggcttggcacttgcaggaattgcaacgttctttgtgatcacaccaaagtatagttcacaagcccaattgatcgtgacactgccgcaatcggaaaccgcaaatgtcaatgatgtcaataccaatctgcaaatgatcaatacgtataaagacatgatcgtcagtgacttagtattgaacgaagtcaaagatcgtctggaatcagaaagcaatgtcaaaatgacggctggagagatcaaagatgcgattgccgtcaatcagtcacaaaattcccaaatgttttcgatccaagcaaccaatccaaatgctgtaaccgcacaaaaaattgccaacaccacagcactagtctttcaggaaaatgccaaagacgtcatgaatgtggacaaaatttccatcatttcaagtgctgttgccagcacatcaccggtatcgccaaataataaattaaatttggctattggattagtgctggggctgatggtcggtgtcggacttgctttcttatttgaattattagatcgtaccgtaaaagacgacaaatttgttaccgatacgattggctatacgattttagggactgtacctcaaatgtcgcaaaaagaattaaatgcgacgatccaaaagaaaccaacaagaccaactttgaagaaaccaacgaatgacaaaacgacggaatctcgtcgcagccgttcgagagtataggaggaagagacatggctaaacaacaagaacgtaaagggatccaaacccatgcagtaagtctgatcactttagtggatccttcttctcctatttcagaacaatatcggacgattcgaaccaatattcaatttgcgtcttcagcggatcaacaaataaaaacattagtcgtcacttcttcgggaccaggcgaaggcaaatcgaccacatctgcgaacttagcagtagtttttgcaaaatcaggacaacgagtattgttagtggatgcagatatgcggaaacccaccgtccacaaaacgtttaatttactgaataatgtgggcgttagtacagttttgagcacttcaacgaatctagctgaggcagcccaacaaacagtgatcgacaatctctccattttaccaagtggtcctaaaccaccaaacccttcggaattattgggatcatctagaatgaaccaagtgatggcggaagcaaagaaactctatgacatcgtgatttttgatatgccgccagtagtggcagtaacggacgcccagatcatggcgtccaaagcggatgggacgattctcgttgtgcgcgaaaatgtttcccgcaaagagccattaacaaaggcaaaagaattattgaatatggtgcaagctcgcgtattaggggtagtctacaacggagcagagaataacaaagattcaggctattactattattacgggaattaatgaattaggagacgaacgaaatgattgatttacattgtcatattttacctggtatcgatgatggtgccgaaacgatggaagcaagtattgcgatggcagaaaaagccattagtcaaggaatcactcacatcctgtgtacgccacatcacaacaacgggaaatatcacaatccaaaatctgacgttatttcgttggtctcttctttgcaatcagaattagaccagcgaaatttgcccttgaccgtattagaaggacaagaggtacggataacaggagatttaattgaggatattcgtaatgatgagattttatttacggatctggacgatacgtatattttgatagaatttcctaccatggaagtaccaacatattccgaacaagtcttatttgaactaaagagccttggcaaaacaccagtcatcgtacatccagagcgaaatgcctattttagaaaagatccgaataatttgcttccattcctagacatgggatgcttagcacaattgacagctccaagctatatgggagtctttgggaaagacattcaaaaaacagcgaaaataatggttgaacacaatttggttcagatggtagcgtcagatgctcatggagtcaataaacggactttttatatgaaggaagcgtatgagcagatcgccaaagattttgaaccaaacaaagtaactttaatgcaacaagtggcgaaagatttgataaatggggatcaaatcgattatccagaatacacaacaataaaaaagaaaaagtttgggttattttagggggcttttgaggtgtttgaattaacaagaagaagaaaaatagccacgttgattctagtggacagcatattattggtttttgccaatattgcttcgtattattttatgaaaccatttgttttgattccgatggattttatgcaaatttcaattgttctttcaattgtcttatactggctatttggctggatttttcgtgtcttttccagaattaatcgttacacgaatctgcgagaaatgattgctatctttttagcgctgacattaagttcaattacaacgattcttcttctttttttcagtaaggaaaattatagtatgcgtctggtgatctctacgtactttctttcgatgttctttatcattgctagtcgattagtttggcgcttgtacatcgagaagaaaaacagccgttgcatacctagtgaagaagtaaagaacaccttaattctaggagcaggcgagggtggccgaattctctataatagcttgttaggatcaaagactgccggggatatcaatgtcgttgggttcattgatgatgatcccaataaaagacatacctatctttctggtaagaaagtgcttggctctatcaaagacttgccagaactagttgataagtatgaaattgctatgataactatcgcgattccttcgctttcccgcaaaaaactgcgtgagatctttgaattgatcgagccattgcatgtgaaagtaaacagtatgccatctatggaggaagtcgcttcagggaaaatcaatctttctcgcttaaaagaaatcgatgtggttgatctattgggaagagatgaagttcagttggatattgatgccatcaaagaccaaatcacgggaaaaacgattctagtgacaggtgccgggggatcaatcggttcagagatttgtcgtcaagtcatccgcttcaaccctcgtaggctattgttactgggtcacggagaaaactcaatctatttaattgatcgcgaattaagaaacaactactcagagtgtgttacggaaatcgttcctatcattgcagacatccaagaccgtaagaaaatctttgcaatcatggaagattatcaaccagaaattgtttatcatgctgcggcccacaaacatgtgccattgatggaatacaatccaagagaagccgttaaaaacaacgtctacggaactaaaaatgtggcagaagcggctaaagcagccaaagtcaaaaactttgtcatggtttctacagacaaagcaaataatcctccgaatgtcatgggagcgacgaaacgaatcgccgaaatgatcgttaccggattaaatgaagcaggatgtacgaaattttcggctgtccgctttgggaatgtgttaggttctagaggaagtgtgattcccgtgtttagggaacaaatcgcaaatggcggaccaattaccatcacggattttcgcatgacgcgctattttatgacgattccggaagccagccgattggtaattcaatcaggggctttggctaaaggtggagaaatctttattttagatatgagtgagccagtcaaaatcattgatttggctaaaaatatgatccgattgagcggttatagtgaagatgagatagaaattattgagaccgggattcgtcctggggaaaaactctatgaagaactgctattagataaagaacgaaacgatgaagctgtgtttgagaaaatttttgttggcaatatcactggctattcaatagcagaagtcatggaattcgttgaacaattatctgatgatgacaaacagctagcaaaagatgtagttgcttttgccaatgcttcaaataaataggagtggatcaggtgtataaagacagggtaaagcgaggaattgattttttgctgtccttaatagggataatcattctttcaccaattttattgattttgtgtctggcaatcaaagtagattcaaaaggaccgattatattcaaacaaaaacgagtaggcaaagataaaagtcattttaatatctacaaatttcgcacgatgaaagttgataccccgaaagaaatgccaactcatttgttagagaatcctgatttttttatcacaaaagttgggaaattcttgcggaaaactagtttagatgaactgccgcagctttttaatattctaaaaggtgatatggccgtgattggtccgcggccagcattgtggaatcaatacgatttgattgatgaacgagataaatatgaggcaaatgacattcgtccaggattaacgggattggctcaaatcagtggacgtgatgagttagagatacaagaaaaagctaagcttgatgggtactatacagaacatattagttttgggatggatgttaaatgtttctttggaacgattacctctgtatttaaaagtgatggtgtcgtcgaaggtggcactggaaccataaagaaggaagatgtcgaatgaaacggattttaataactggcgcgaacagctatattggcacctcttttgagaattggatgaagcagtttggtgatgagtatcaaattgatacattggatatgcatggagaactctggaaagaaaaagatttttcactatatgattctgtttttcatgtagccggaatagctcatgccgatgtttcaaaagtaagcgaagagaccaaacaactttattataaagtaaattgtgatttagctgttgaaacagctcagaagtataagaatgatttaaacggacgaattggtcagtttatttatatgagttcaattatcatctatggggaagaaacaaatatcaacaagaaaagagtaattacacccgaaactgaaccaaacccttctagtttttatggggacagtaaatggcaggccgaaaaaagattaactttgttacaaagcgaaaattttcagctcgcaattattcgaccacctatgatctatggtgaaggtagtaaaggaaattatcagcaattagtaaagattgctaataaactcccaatttttccaaacataaaaaatgaacgttcaatgctaagtattattaggttatgtgaatttattaaactaagagttgataactcagatagtggtattttttttccacaagatgaaaactacgttaggacaagttatatggttagagatcttgcgcttgcaaatggaaaaaagatttatttgttttcatggctgaattggtctatctatttgttgggatattttccaggaagaattgggaaattagttaataaagcttttgggaatcttatttatatgaagaataaggatgtgactaagtgaaaattactattgttaattgttttgatacatacgaacaaagaatcgacatgattgctaattattttgaaagtaagggttacattgttgaaattgtggcatcaaacttccagcatataaagaaaataaaaaggatagtttcaaaaaagaattattcattcattaatgtccctaaatataaaaaaaatatttcttttaaaagattgttatcacatctaatattctcaaaaaaaagttttagaaaaataaaaaaaaataaaactgatattatttacgtagtaatcccacctaattcgattgcaaaacaagcattactatacaaaaaaaaatatcctaaaacaaaaattgtttttgatttaattgatttatggcctgaaacaatgccttttaagaaaaatttttctccagttttaaatatttggaaaaacagacggaataattatttaaaaattgccgatctaataataagtgaatgtgacctgtatagagatatcttgcataaagagcttatagattgcaatgttgaaactctttatttagcaaaagaaaaaaatacattgggtgatttgacccatgcttttgaatctaaagttgttttttgttatttaggctctataaacaatatcattgatattcccaaaatatgtgagttaatgaaagaaatgaaatcaaaaagagatattgaaattaatattattggtgatggagaaaagaaagaagaatttattaaaaaactaaaaaatattgatatcacagttaatgactatggtattgtttatgatgtggaagaaaaaagagaaatttttgagaaatctcattttggattgaatattatgaaagaatctgtttgtgtaggattaactatgaaatctattgattattttgaagctggtctgcctttaattaataatattgatgcagacacgtctaaattagttaaagaaaataagtgcggatttaatttgtctaataatttaaaaaaagatgttaataaaataattgaggtaagtgaaaaggactactattcaatggtagataatacaaaaaatgtatttagatcttatttctcaatagaagcttttaatgacagaatgaaagttattgaggacgcacttataaaaaatattcatgaataactgggaaggaaaagatacatggctaaaataagtatcattattccaatgtataatgctgaaagaaccattcaattttctttaggatccatcttaaatcaagattatcaagattatgaagtattagtagtagatgatggatcgacagatggatcgagaaccattgtagaaaaaatgtcggataagttttctggtaaaatttcatactactatcaagataattctggtcagagtagtgctagaaacttgggattaaagttagcgcagggacaatatatatgttttcttgattccgatgactggtttgataaaaattatctaaaatatctaattgaatttattgagcttaatcacttagatgttgtagaatgtgattttcaagtcacacaaaaaatggagtatacaagcaatgttataaaaacagattcgtatattttaagtggaatcaatatcttagaaaactatctatataaaggtataaaaattccgaatagttcttattcagtttgtaacaaaatgtttcgaaaggaatcaatcgaagatgtttttttctcactagagccattttgtgaagattatttatttaattttatcattctcaaaaatattaatttatatggtaagttagattatatcggatataattactatcggaacaataagagctctactcaaagtcctttaaaaatacaggataagggtatgattaataattgcagaacagtgtataatttagcactagatacaggaaacaagacttatatttcctatgctagaactagatactatcattcttttttttctttgtatttgaaagctttgagatatggatataaagaagatgctggcgattttttaaaagaattaaaaaaaggaatgcgtagtggactaagatttattattaattctaaaataccaaaaaaaagaattgtaattttgctttttgttttcttatcttcaaactttattaagttgaaaaaagtaggtgaatagattttgaccccatatatccttttatgtatttgtttttttacaggtagtattatcaattcacttcgctttggcaacgaagtaagaatagcgcattactttaaaacatatatcgttttttttatgttttatctaccgttggtaatagttagtggttttaggtataaggttggaacagattacaatacttatgaaaatattttttatcaaataattaatggaaataatgatttgaaaagtttaaatatcgagtggggatattatattttaaataaaataggaatgtttttatttgagaatccgcaaataatatttttgttatctacgattataattattacattttatacattgggaataataaggcgatctaatgacataatattcagtttttggacgttcttaggattgggaatgttttttaattctatgaatggattgagacagtttattgctatctcaattatattttatgcctatagttttcttgaaaaagataaatttagatcgtttatactattaggtttagttgcctgtctatttcatacaacagccattatccctttgtttgcgggttttgtaattaaatttttaccaaataggatatttttcattagttcaggtgttatcagctttatagctcttgtaagctccaacataataactaatattttatataagtatggcatttatactttttaccttaataatagtcaatcatttatgaatggtggattatcatattttaatatcttgttagcattgatagccataacaatgactttgtttttttataagaatttaggtgaggaaaaagaaatttttatccggtttaaactgatttggataggttttttattggttacttgtttttctaactttggagatctggcagtaagaatagctttttattttacgagcacatatattgtgttattcgctaacttagtaaataaaatccatgacaaaaagatatcctcaataataaaatttatatgttatggattattcctcttcattacattttacttattaataaataataataataccggtttgaaactattaccattttcattccgtagtgtattctgattggagtattaagtatgaatcctattttaagtgttatactacccgtgtacaacgttgaaaattatctggaagaatgcctagattcacttttgaaccaaacatttacaaactttgaagtcattgctgttaatgatggcagtagtgataattctcttgatatattattgaaataccaaaagttatttgaaagtatgaggattatttcacaagaaaatagtggtctctcttcagcaaggaatacaggaatcaaacacagcaaaggaacttatatatattttctggattcagatgattacataagttataacacatttgagaaggttatagaaatatttaataaaacgaatgttgatcttgttaagtttgatgctactccattttcagatgatcctagtttcaatgtagatctaaatgagtataactccaacaaagtttatcaaactgaaaaggtttatggaaaaagtgattttcttaatttaattgaaaaaaaataccaagctccagtgtggctttatatttttagggcagagatattaaaaatgaataatctttcatttagaccgaacttattgcatgaagatgaattatttactccaaagttattagtaaattgcaataatttttactacataaacgagcaattctttaaaaggagataccgaaaaggttcgattatgacaactcaaaataaaaagagatcaattttaaactacaatattattataaatgatttatataaatatagtgaaaacttcacggatgaagaaaaaaaatttttgattaatcgtataaaaggaatatattatacatcttcttgtctaagcatgaactatactaataaatattgtgggaaattaactaattacggaacaagtttgactatgaaacagaaaatgaagttattaattaaaaggttagtgaggaataataaatgaaaaacattgtaaagcaaaaatattattcacttatatattctaaagaactaaataagctcagaagtaatagttctgatagaaaatttattgtattatctacacccaatcatggcaatttgggggatcacgctatcgcattagctgaaaaaatgtttttagaagataaaaatatctgtaaaaatatagttgagattacaagctctttttatttatcgaataaaaagatcataaacagtttaatttcagacgaagatataatcttgattacaggaggaggatttttaggtagtttgtggatgggagaagaagaattagttagagagatttttcgaacacataaaaataataaaattattatttttccccaaactattttttatgaaaacagcagttttgggaacgaggaattagaaaagagtaaagaaatatacaagaaacattctggaaaaaaatttattatgttaagagacaaagtttcttataagacagttttggataattttggagagtcatttgatgaagtagcttattttccagacatggtactctacttaaatgaaaaaaaagaagatattaaaagagagaataaaatattatgttgtttcagaaatgataaggaaaaaatgggaaattttagtaagaaagagtattttgaagagttactaaatggtgatattctgaataaatatattgtaaaatttacggatactgttgtgaataaacgcatcaatataaatgatagaaatgaagaacttgataagaaattcttagaatttaaaacatcaaagttagttatcacggacaggctacacggtatgatatttgctgcaataactggtacaccttgtcttgcattcgacaatagtagtggaaaagttaagggggtttttgaatggattaagaatataaattcaattatttttttagatcaaataacaacgaaagaagatattttggctaaattagcgtatttattagatttagaaataagcgaattagaaatagaagtaagttctgaatttgataaaatgtctgatgaaataaaaggttttgtataatatgaaattcaaattaatctatattaataatagaaacctgttatttggaataattgcactgtcaataaatttagctttaaatctatttgtttctccctttatagtaagaaatttaggtgttgaagcaaatggatatattactttagctaataattttgttagttacgcttcactaatatcagttgctctaaactctatggctaatagattcattactttagagtttgtaagtaaaaattatgaacgagctaatttgtattattcaaatgtaaccataggaaattgtatcatcggagcgattataacaatattttcgatattttttaccaactatataagcttttttttggagattccaaacgaattaattaaggatataaagttattatttttaataacgttcttaactttttcaattactacggtgacttcctcctggaacattgctactttcttaactaataagttgtatattcagtctgtgaggaatatacaatctcaatttattagagcagcttctatactaattttattttatttttttcctataaaagtaagttttattgcattctcttcatttattgctgcgcttttttctgttcttttttcgttatattacaagaaaaaattaacaccatttctgaaggcttctttcagattgtttaatattaaaactttaaaagaactagttggctcagggatttggaattctgttggccaaatgggggttatgttattaacgggtttagatttgttaatagcaaatatatttttaggacctgagagcatgggaatattagctctggcaaaggttttaccaacaataatttctcagctttcatctactgtgacaaatgttttcattcctcaaataactttatattacggagataagaagatggaagtgatgcataattacttagaaaaagcaattgcgttatctaattttataataacgattcctattgccttaataatttctttgggctacaatttctattcgttatgggtaccaaatcaaaatatacgtttgatattcattctttgcttgttatctctaattggaacaattttttctagtggaacagaagtccttacaaatatatttgtacttgttaataaaataaaaattaattctttgaatattgttttttctgggattataagtataatagtatcatttgttttcgttaaatataccgaatatggaatttttgctatagctagtgttagtagtatcgttaatgtgataactaaaatagtctatacaataccattttcgtcaaaatatataaatataagctggaattatttctatatttatacatttaaatctattctgagcgttattctaattagcttgtcatcttttttatttaacaatttagtgtttactgaaaaaaatgattggattcatttttttattaaaggttttgcaggtgtaattatagctttaatcattaattttattatatatagaaaagtattgtttaggagaaatatatgaatttaattactttactaagaagaacgaagttatatgctaatataccaattaatctaattttagaacgttttcatgaaaagcccaaagttttgagttttactgaaactataaactatataattgaatccgaatgctcagtttcgagattcagtgatggtgaaatgggaataatagatcaaaatcattcccctggttttcaaaaattggataagaaaatggcagagcaactaaaagcagcccttaaaaatacaaatcaagaagatcttcttatttgtgttccttatgtttttgattctagtaacttaaatttcagaactgatgaatcaaaaaaatggtggataaaatatcttttatttaatagaaatcaatggtatcaaaaattagatttctcttatacgtatggcgctgctaattttacaagattatatatggcggatcgtgaaaaagattcaaaaaaaatgaataattattttaattcaatcaaatcaatttgggatagtaagaatctattaataattgaaggagatggaactaagatgggagttggaaatgatttgtttagaaattctgggaaaatcaaaagaattattgctcctagcaaaaatgcctttagtaaatatgatttaattattaatgccgccatagatttcctcaaagataatgaagattatttgtgcttacttgcattaggacctacagcaagtattatgtctcaagatatttgtaggcatggttttcgtgccattgacattggacacattgatacggaatatgagtggtttacaagaaattattctgataaggaagctattccaggtaagtatgtcaatgagtcaaataatgggcagctttattttgaaattaaaaatagtgattatgaaaaacaaattctatctagagttggtgattcattttgaaaggaatcattttagcaggaggttcaggtacacgcctgtatccactgaccaaagcaacatccaaacaattaatgcccatctatgataaaccaatgatctactatcccatgtctacattgatgctagcagggatcaaagagatcttgattatttctacaccacaagataccccgcgctttcaagaattatttggcgatggtcatgaacttgggattcatctggaatatgcggtacaaccaagcccagatggattggcgcaagccttcttgattggcgaagaatttattggcaatgacagtgtctgtctgattctcggcgacaatatctactatggtggcggcttatctaaaatgctgcaacgtgcagctcaaaaagagcaaggggcaacggtatttgggtatcatgtcactgatccagaacgctttggcgtggtggaatttgacgagcaaatgcaagctgtgtcgattgaagaaaagccagcagcaccaaagtccaattatgcagtaacaggcctttatttttatgacaacgaggtggttgagattgccaaacaaatcactccttctgaacgtggcgagttagagatcaccgatgtcaatcaaagataccttgaattaggaaaactatcggtggaagtgatgggcagagggtttgcctggttggatacgggaacccatgagtcattattagaagcttcgacatttattgaaaccattgaaaaacgccaaaatctaaaagtggcttgtttagaagaaatcgcttatcgcatgggctacattagtcgtgaagcgctgattgaattagcgcaaccattaaagaaaaatcaatatggtcaatacctattgcacctagcaagtgaggaatagaaatgggaaaattacgtatcacaaaaacaaacttaaccgatgttgtcttggttgaaccagcagtctttggtgatcaccggggcttctttaccgaaagttattcgcaagaagatttcaaagccgcaggcttagactatgcgtttgtgcaagataatcattccttgtcagtggaagccggcgtcttacggggcttacactttcaaaaaggagaggctgcccaaacgaaattgattcgtgtcgtgacgggagccgtgctggatgtaattgtggatatccgaaaaggaagtccgacctatggtcaatgggaagggtatatattatcggaaagcaaccatcgtcaattgttggtgccaaaaggatttgcccatggctttgttacattgacaccgaatgtcaactttttgtataaatgcgacaactattacaatgcacaagcagatgccggcattgcatttgatgatccagaactagcgattgattggccgattgccaaagaacaagcgattctttcggagaaagatcaacaccacccaaccttacaagcatttgaagctgacaatccatttgtttacggagaaatttaaggagtgttcatgaaatgaaaagaatcattgtgaccggcggagctggttttatcggatccaattttgttcattatgtggtcaatcaccaatcggatgttcatgtgacggttttggataaattgacatatgcgggaaacaaagaaaatctagccggactaccggaagaccgtgtggaattagtggtaggcgatattgccgatgcggcattagttgatgagctggtccaacagaccgatgcggtggttcactatgccgctgagtctcataacgacaattcattaaaagatccctttccttttgtccagactaatttgatcggtacttacacattgattgaagcttgtcgcaaacaccatgttcgctatcatcatgtttcgacagatgaagtgtatggcgatcttcctttgcgggaagatttaccaggtcatggggatgggccaggcgagaagttcaccgataaaaccccctacaatccctccagtccttattcgtcgacaaaagcgggatcggatttattggtcaaggcatgggttcggtccttcggacttcaagctacactctctaactgttccaataattatggcccctatcaacacattgagaagtttatccctcgacaaatcaccaatgtattaagtgggattcgccccaagctttatggcgaagggaaaaatgtgcgtgattggattcatactaacgaccattcttccgcggtctgggcaattttgaccaaaggagccattggggaaacatatttgatcggcgccgacggagaagaagacaataaaacagtgattgaaatgattcttgaattgatggggcaatcaaaggatgcctatgaccatgtcaatgatcgtcctggtcatgatttgcgctatgccattgatgcaacaaaattaagagaagaattaggctggacgccagaatttactaactttaaagagggcttggcggatacgattgagtggtataaaaccaatcgttcgtggtggcaagcagaaaaagaacaagtcgaagaaacttatgcccaacaaggacaataatctgtaggatgaaagcaggaggattcctgcttttttcgaaaggaagcgaagaaagatgtatttaattactggtggcaagggtcagctaggtactgaattacaccatttattggatgaaacgggtgttgattatgtctcaacggatgctcaagaaatggacattacggattcagaagcaactatgagaaaggttcaagaaatcaagcccaatgttattttccactgtgccgcatacacagccgttgatcaagctgaggatgaagggaaaatacttgatgaaaaaatcaatgtcgatggaacccgaaatgtggctcaagcagctaaagcggtgggagctactcttgtttacatcagtaccgactatgtttttgatgggacgaaaaaagagggggaatatcgtgtcgatgatccagtaaaccctctaaatgagtatggtagaaccaaattattgggtgaacaagctgttcaagaaatattgagtgattactatatcattcgtacttcttgggtttttggacaatatggtcataattttgtttatacgatgcagcgattggccaaagaacatgaaagcttgaccgtagtgaatgatcaatttggacgtccaacttggacacgaacattggcagaatttatgaaatatgtgattgatcaaaaatcacctaacggcgtttaccacctatcgaatgacaattattgttcttggtatgaatttgcgaaagaaatattaaaagataccacagtcgaagtaaatccggtgacttcagaacaatatccgcaaaaagccaaaagaccacaatattcagtgatggatctgtcaaaagctaaagcaattggctttgaaatcccaacgtggcaagaagcacttcactttatgttgaagtaaggaattgtttttattacaattctaaaatcatttttttaggtcaaagatttagtttgttttataacgctgtattacattggtctacaaagctattttgaccctataaaattgaaaaactgagggaagacagtcaccaaataaccgtcttttattaactcaaagcctaaaaacaccacccctaagaagataccccatatcttctttttctttccccaaaaaatcccctcaaaaaactccacgaaaacgtatgttccctcttgtcaaaaggtaacgctttctatatgatgaaatggaatagaaaccaaataaaaaaaggcactttctacgggtgttggcgcacctgtagaaagccctgatcagtcaccaagtttacacagctgaccaatcaagtttgccatagttgtttcccgaaggaaccaacgtgtttattttaccgaaagttgatagcgattactagtcgctttgtgcaattttttgaaattttcacgtttttcctgaggtttatttcgctatgtcaaaggcattggacacgctggtctgatgccttttttgctgtttcttgatcgagtggttttcatgggaatgggacgctgtttcgttattggaagctgcttttgttggcggatcaagaaatgctttcatcctaggtaaaaagcaagagttggtttctattcgcctttcatttttcactgttggcattgatagaattagaaacggaggaaaaaatatgtcagtgatccaggcgttgatcatctcaatttgggtggcgttgattcaagcccgcttcttcgggtatgcaggcttgaatttgcggtttagtccgcttatgacgagtttatttgtcggtgtcgttctgggagatgttgcccaaggggtaacggttggtgcagctatccaattgatttctatgggtcagattgcgccaggcggccagatggcaacagaaccggctgtctcgggaactgtggctacagcagtcgctatcttgggtaatctagagccgacagcggcagtagcaatcgcgattcccgtcggaattctaggaagttatttatatacattaaaaattatcgtgaattcttttgtgaccaaatacattgatcgggtggtcaataatctggaggacaagaaatttacttttgcaatcggtctgttgccaaccctattgacgatgctgactcatgtgccggtattgtttatcgctttatatttcgggacagattcgatagctaatgttgtgacacaattggaaggcacggttgtctttcatatactagatgttgtcgccagtgcgttagcagctgttgggatcgcgattttgattcggatcattggtcaaaagaccgatatgttctttttctttttggcattcttcttaacgattattttgaaagatttaggaatcaccatggttacttgggctgtactgggtatcgtgactgcaggcatttacaccatgattatgatcaatgcaaaggaggcagcctagatggatgcagagaatacttcgactgaaaacaatggactgactaaaaaggaactgaaccagatttggaatcgctggtactggatgaacgagatccctcgcacctatgagcgacaagtcgcaccagcgttgatgtatgcattgacgcctctgcttaaaaaaatctataaagatcctgaagacttgcgggatgcctacaatcggcacttgaccttttggaacactgatgcgatctggggcggcagtaccatttctgggattactgcatctctggaagaacagcgggccaaagagttggcagaaacaggttctgaacagaccgtttcaacagaattgatcgaagcaacaaaagtcggattgatggggccaatggcagggatcggggattccattaataatggcacgttgcagtatttactgattgcaattgcactgccttgggctgcagatggtttgtggttcggtgcggttattccctggatcgtcttttctgttgtaacgtatctctatggccgtgcgtttgtccactttagttatcggttaggaaggcaagcggctcgagaactgattgccgggacgagagccaatttaattatgaaagcattgacgatccttgggatgttcatgatgggagtgacggcggcacggtttgtgacgattcaatcttcattatcttttgtcctgtcagaaagagaatttgctttacagagtattctggactctatcttgccaggcatcttaccactttcactggtcatgggcttgtacttctactttgaaaagaagggtctgaatgtactaaaagggatgttattgttgactgttatcgttggattgctggcagcgatcggaattttataaatcagaaagagggtgtcacagatggggaaaattacttttgctcgagtagatagtcgcttgattcatggtcagatcgtgacaaagtgggccaagtcttcgggtgcgaatacgatttatattatcgatgacgcggtgcgttccgatgatttttcgatggatatttacatggcttcaggaaaacgttacggctttcaagtgaaggtatacagcatagcggaagtactggcagcttgggaagccaatcaattcggtgcagataaagtatttgctttgttcaaaacggtagcaacagcgatcaagtgtttggagttggggttaccgttaccttgtttgaatctaggcggcacgccaaaaagacaatcggccgagttctttatcaaaaatgttgccctaaccgagacagagttggaacaattgcagcagttatcagctgaaaagggcatcaagatttatgcgcaaacggttcccgaagcagcgaagaaatcgatctaggggggatgtcgatgaaaaaaattgcagtagtcaattcaaaaagttttggtaagttttttccggaacatatccaacgactgcaagcatttggtgaagtggactttcatctgtttgaaccaacgattaaaggggcacaactggctgaggcactcagggactatcagtgcattatcgctagtgtcacgccaactttcgatcgtacgttttttcagaatacaccaaatctaggattgctttgccgtcatggtctaggggtcgataatgtagaccttagtgctgcaaccgaaaatcaggtactggtgaccaaagttttagggccaatcgaacggcaagcggtagcagaacatgcgattgctttgttaatgaacgaacttcgtaagatcaataaagggcagcggctgatcaaaaatgatgagtggcacttgcggtcgagttgtaatagttttgaactcaagcacgcaacggtcggtgtgattggctatggcaatatcggctccaaggttggccagattctgcatgaaggctttggtgctgaagtgctagtctatgatccttataagtctgctgaagatattcacaaagcaaaaggaaaaaaagtatctttgccggaattattgtcagaagcggatgtcatcacacttcactgcaatctttcagatgaaaaccagcggatgctttctgatgcagcttttgatcaaatgaagcagcatgtcttgctgatcaatactgcacgtggggaattggtggatgaagcagctttgatccgtgcgttggctagaaaagaaatttccggttatgctgccgatgtcttttgtcaggaaccgttagatcctacgcatccattactggcttttgaaaatgtcacattgacccctcatatcggtgcgtatacttctgaaagtttagccggaatgggagatcatgtagtgacgaatattgagcgcttttttgcgcacttagaaccctttggtctggtgaatgaaaggagttggtcggtatgattggtatgcaaattatttctcatggcgaactcagccaagggatcgttcattcgttacaaatgatcattggtgagacacagcagatggcgttcgacacacttgctgaaaatgaagaggtcgacagtttccgtcaaaaaattttagatcaaagtcgcaagctggatagggggcatggggtcttagtatttgttgatatgtttggagcaacgccttacaactgtgcttattataattcacaattttttgaccctaaccactatcagatcgttgccgggttcaatctgccgttagtgattgaagcaatcatgcaacgtgaacagatgtctttgtcacaattagtcgcacatttgcgtcaggcagcgatcgacacgattgtctttcaagacaaatatgagtgaagagaaagtgaggcagtctatgtatacggcattaatgatgcgtcccgaggacaatgttgccatggttttgcaaccaacgccggcggaatcatccgtgaagattgttaatcaagcgaccttaaatgaattcctgattgtccagtctattgacagctaccataaattttctgtaaaagatattgaatctggcgaagagattatcaaatatggcgaagtgatagggattgctacagcagcgattgccaaaggtgaacatgtgcatacacataatgtgaggagcatcagagtctaatgaaaccaataatgggttataaacgatccgatgggcaatatgggatccgcaacaaaattttagtcattgcgacagtgggctgtgccaatgaaactgcacgccgtctggctgaacgaattgccggcacggtctttatcccagctggaaaaggctgtggtcaaattggagatgcagtagaaatcaccaaacgaacgttgacgggatttgtcttaaatcccaatgtctatggggcagtctttgtcgggttaggctgtgagacgattcagcctcacgaaatggtggctcgggttcagaaggtatcagacaaaccggtctactcttttagcatccaggaagaaggcgggacaacaaaaacaatcgcgacagtcgttcctttattagaaagactggtaggcgcggctgcccggattgtgagggaacccgttgaactatctgctcttactttagcgaccaattgtggcggcagtgatgcaaccagtgggttatccgtcaatcctgctttgggagttgcgacagaacttttggtagctgcaggcggtcgatcgatcctaggagaaacgacagaattgattggcacagagcatatcttgatccgtcgtgccaaaaatcaacaagttaaacgggatattcagactatcattggcggtctcgaaaaacaatttgaacgtctccaagtagatattcgaggagcaaatccttcacccgggaatcaaaaaggtggtttaacgacactggaagaaaagtcactaggcgccatcatgaaagcgggacacgccacgattaatcaagttgtcaaatatggagagatcgccactgaaaaaggggtgatcattatggatactcccggatacgacattgaatctgtgacagggatggtggctggcggagcccaaatctgtgtatttacaacgggcaggggcacacctatcggaaatcccatcgtaccaatggttaagattaccggtaatcatgagacgtatcaacaaatgtctgaacatatggatcttgatttatctgcgatcattactggcaagatgtccatcaaagaaggcggcgaaaggatcctttcggaaatgatcgaagtagcaaatggaaaacgaactgcagcggagaaattaggctttcaggagctagcgatttatcgcaacaatgaagtctggggctgtgatttataaaacagccccaactaaatactgctaaacatcctatctaggtgatttagcagttgctattaagtcgatcgtacttttgaaaaactgtcactttcagcaatcgtcattactgcaataaaaaagaaatatcaagaaagtacaatcaagcaagaactgttatcgaaaaacgatgtagcgccctccagaagttagctgtttcagctatcctatagagggcgctctcttacgaatagattcttgaaggaatgtgtaagagggccttttcggatagaggacggatttcttcgtgaaaaaaatgcctagagaggaggcacaaatgagtctatcttctttgaagcaataatgggttaggattttaatataaaccggtatattttagtatcatttaagcgctagactttttataattggatgaagcggttacaaacaagctttgatgtcatagatcaataagaagaattccaggttgataataggaggaacaacatgttagcgaacagtgagccattgcagcaattgatggatttaattgaaatccccgttttagtccaagagaaagtgaacgcagccttagaggagctgcaagaacaagagatgattactagtgtacataaattgctcgatccagtaacagcttcagcagaagccaagtggttatcccaactgtacaaagaggagtcgatgaaggaattggcgatccatttgtatgcagcgaccatcagctggaaacatatttatcaaccgctgcaaattcctcatgagatttatttggctacgatgagggcatttactcgattcttaaaagaaacgaaacaagccggtaatcaggatgtgtttgatcgtggattttggacatggcggtatttgtgcggattagaatttaggatcgatcagctagaatttgaaatgatcgccgctgatcataagagcaaagcaccacaacttgaaggtcaaacctatctttctcttcacatcccttcagatgcgaaactggttcatgagcaagtccaagaaaattatcagtcagccagaatgttttttgaaacctactttcctgcatacggttcagcaccaatcgtgaccgatacttggctgctttcgcccaagttgaaagaatggttgccagcgtcttccaacctcgttttgtttggaaatgactacgaactgctgttgacagaaccagcaaagaatgacggcgtactctgggtcttcaatactatttctaacgatgtcggaaagtatcccgaaaacaccaccttacaaaaagcagcgaaggcatggctgttagcagggaatgcgattggatcggctgtcgggcgcttgcagtaattttgcactagtaggaacatgactatcccaatgcttttaccaccggaatggtttttcctgaagaagcgattgtagtagctgcagctgatttggcaactggacgattcaattgactgtggtgtcgatcattcaatgaaaatcaaacagagatagaggcgtgcgcaatgagtgagcatgcctctatctctttgtgtaacaaacctccgatttatttagtctgaaaagaatcaaaaagcaatttacgattcatgcgggaatctaacaagttgattgcaacgagatgtcagaattttgcatccagatgtttttcctgtgattctgcccaaaagcagcaaaatattcggtatgctagtagaaatgaaaagtaggattcaaaaggagatagcatgaaaaaactggaaaaattgatagtcgcaagctcgttgatgttgataggttttccattggttgcaaacgcagaggatgtcgatcgtcaaattcaacaacaaacccagcgaatcaatgaaatcaaaagggaatctgcttcaatagaagcgttcaaacaaaagacggaagcggagatccaacaacttgaatctgaaatggattcgattttggcgtcaaaggctagcaccgagcaaaaggtcaacaaaatcgcaagtgacatcaaggagttggaagaaaaaatcgctaaacggaaagaaactttggcgaatcaagcacgagagatccaagtttcagaaccttcgaatgccatgatgacgacattgcttgatgcggactcactaggtgaagcaattcaacgagcgattgcatctgttaccatcatgaatgccagcaatagtatcgttgagcaacagcaaaaagacatcgagacaagtatcaagctcgaaaaagaactagaagaaaaactatccgaaattgaaactcatgcgagcgagctgcaacaaaagcaaggggagcttgcggatgtacgattgaatcagtacgtggcattagccgacttacgactgtctctgaatcaagaagagagcaagaaatctgacttggaagcagataaagcggctgctgaaaagaaacgggaagaaacattgaaacaattagcggcagaagaagcgttagcagccgaagccaagaaacaagcccaagcggaggaaaaaaaagctcaggaacaagttgaaaaagaggtagtcgctgagacagcagcttctcaagaaaaagaatccgcaaatgaaactggttcagaagtaacgacatcagcgaatgcttctgaaccaatcaaagaagagaccagcattgaagaaacaagcaacaaagagaccaatcccgaaattaattcagaaacaccgggacttgccagcgggaaacaaacaagcggttggtctttaccggtcgattctgtccatatctcgagtcgttttggataccgtacagatccaacgggctcttccggcaaccagcacaatgggatcgactttaccggcagcagtggaacaccgatttatgcgattcaaggtgggaaagtggtagaagccggttatggtccgtccacaggaaattatgtgatcataaagcatccgaatggcatctatagttattacatgcacttcaatgcattgcctgctgttagtagcggtcaaagtgtcacagcacgtcaataccttggtggaatgggaacaactggaaattcgactggtgtccatctacatttgggaatggcgacaggactatggtcaggcttctttgaccctgcgtctgaattaggcctctaataaaaaaagcagcggctgcttgcagtgatccgaaaagttggaccaaaagtcaacttttcggacacacttcatttttgccgctgctttttattatggtcattgcttgctgtcctcttttgagaaaagaaaggcatttcaggcattgcatcagccaactgccaatgggttcagctgacttgcggtttcgcttgcggatcttgcttcgaagatcagttgctctactcggctaaaccttctaacaacgctagccatcgctcagcgagctgctcactgctgcaagtaactgtaaatgattctttccctgtcatttcgacatagatctctgtctctgaaattttaacaatacgcatactagttttcctccttcgcagcattccgccactattttcttaaagtaattttttcttaaagcactattttcttaaagtaattttttcttaaagcactactttcttaaagcactatcttcttagagcactattttcttaaactagtacctttttgtttctcaaaaataaaatacgcgaaaagatcaaaaaatttttttcttttgcattttcttttaaattaattgcaattgcccctttttggatcaaatgcgttggtaagagtaaaatttggccaaatgcactcatttttggcgcattttttgttggctttcttctgcatagagatcttgataaatcagactaaaacttcctcgtttgccggggagatcgtgaaaatgaagctcccctagtaaatgattggtgagaggagaaaaagaaaggtccagaaattcagtgaggctagtattcgcccgaggcagttgatagctatgttcccgtttgataatgccatgagcaagaaaactgatcagcatggtttgctttagacgacgggattcaaccgagctgggaaaagagaactgattgtgcagttcaatgaacagctgcggtccagaagcggacaacgtcatgatttttccaggattgacccaaatggtgtcttttttggtggcgtttgttagtggtagcaagctgtattcgctagttgcacaaggaatcttgtattgacgtttgatattcgactggctaaataaatggtacagtgtatctttgaaaagcgcgtactcataaaaatggaaatggagaagaatctgtttgatgataggaaatggcggctgtggaagaagtgaacaatagtcttgataaatgatcaaagaatgcgtgcgatcatcacgaacaaaaggcagaatggcaaaaatttctttctcgaagtcaattgtcatggttggacggatcaaagcagcaagttcctggcaagtggcctgatcactagaattgaggaatcgtttacattttggctcaaaggacagacgataaggatcaagtttattcgaacttataggggagtagcatctcttcatagaaaaactccttcattttagatacttcaactataaaattatctgactatttttgcaataaaaagtgcataattcaaatgatttattgatttttgataaaaatagtcacttcctctttttgctatggttaatgtacccgcgggaacaccaagcaaaaggaggaatacaatgaaagaatggcatacactgatggcttcttatgagcgcctcttttacaaagtgctgattcgggcgggcatcttccccagtcatccagattttgaagattatttgcaagagttgcgactcatgctctttgagcgcgcacgaaggtatcctgatgaagggatctttcgcaacgaaaatgaagtgaattatctatttggctttttgctatggcgagtgattgatttacaacgaaaaagtaatcgtcaaaaacaactgattcaagcaatcgcatcagagcaggaagaaacgattgatctgaaagaagacatcgacaatcatctattgctgatgcaattctgggcatttctgaaaccgaaagaacgacaaatgtggcttgattgggtcaatcaagagggatcaaaacagtctcgctattattatcgtcagaagttgagagcccgttggcagcaatttattcacgaggagacgacaagcagcaaaaaataggtgttctatttagtcagaataaaagtgaaggacccagacaggagctttcttactcgttcctcttgtatcgtgcagcttctttttgtaaactgaaatcaaggaacaaaaggcaccttttgtctaaactgttttcgcattatcgacaggtaatgacagtttttcttggtacttgataaactccttttatgttgaccatgatttggtgccttaagttctaattgaatgagaagcgtcatttttccaaatcatattaacagcaatcgtcgaataaagcggtcttcgaatggaagaggccgctttttttcgtcaattcgcgacttaaaaaggcgctttttttggtcagactatttctagaatacggtggatattttggtagtcaaaaacagcaacataggctatactttggctatcatcatacgatatgtatggcaaagactgagggccttgactgatcacttgcaaagcgggagtatcaaaaagcaagtgggcaaaccagcaaatgatttgctagtgaatagacgttggtcaataggaggaatgaatgatggggaaaattgatatttccaatctgacacgagattatggcaatggcaaaggaatttttgacctgtcattttctgtggaagcaggagcgtttggttttctgggtcctaatggcgctgggaagaccacaacgatccgtcatctaatggggttcatcaaacctcaaagcggcaactgtttgatcaatgggatgaattgctggcagcaacgagaacaaatccaaagaaatttaggctacatccctggcgaaatgactttttttgatgatatgaccggaagcgaatttattaaatttatcgcaaagtatcggggaaatgctgaaaatggacgggccaaagaattacttgatcgatttgagttagatccgaacggcaagatcaagaaaatgagtaaagggatgaaacaaaaaattggcatcgttgtggctttcatgcacgacccagagatcttgattttagatgagcctactagtggcttagatcccttgatgcagtcacgttttattgatttaattactgaagaaaaaaagcgcggcaaaaccatcctcatgtctagccacatgtttgaagaagttgagcggacctgtgatcgaattggcatcattcgtgccggaaaattagttgcgttggattccaccgacacattaagagaaaaacatctgcgtcgttataccgtcactttgccaaatgaacaactggcggcagcctttgcagcagatttcaatggagaaatcgatccggcacaacctagtcaagttcaagtcagtacgagtcaaacattggaacagatttttatggattattatggaggtgaagagaaatgatcaatttcaccctttacaaacgcgaattgcgccgcagcatcctgacgcttgtgatttttggtgccgtcatgaccctctacatctcaatcattgtcagtatgtacaatccagaaatgatgcagtctcttgaagaaatgcgcaagatgctgccagaattgatgtcggcagtcggcatgaaagccggcgctaactcattattgggtttcatgtcttcttacctctatggttttattttgatcatttttccaatggtattctcgattcttcgagggaatgcattgattgccaaatatgtggacagcaacgcgatggtggcccttctggcagcacccatcaagcggagaacgattgtcatgacgcagatgtcggttcttttaacgggtattttctttttgatcatctatggcactgcattagagatcctttgcggattacaatttaaaggagaactcgagattcccaaactgttgctgctgaatggtgggttgctttgtttgcagttgtttatcgcaggaatctctttcttagcttcttgtgtttttaatgattcaaaatacagtattgctgtcggcggtgggataccagcattaatgtacgtcttacagatgcttgccaacaccggcggaaatgcagaaaaagtaaagtattttactttctttacattgtttgatccagatgctttgatcgcaggagatcgtagtggtctcatcggaatctttgtcctattgattggagcgtgtatcctgttcgtggcatcgggcatggtcttttgtaagaaagatcttcatatttagtgaacaagcaaaaaacaatcactccaatcctgtatttggagtgattgtttgttttacccttgtgcagctttgcctgtataagaataaaaattaattgtttttctccgcgacaaaagcatcgacttccgctagatacaacttcttctcttcttctggtaaccaagcaatctcaaaggcatttctgaccaattgaatgatttggtcctctgttagctgataatttttgctcaatgcataaaggtcgtcagaaatatagctttggaaataagctgggtcatctgaattgatcgtcactttgacgccttttgccaataactcgatgatttcttttcctttcatatcatccacgacgaaactgttggagacagggcaacacgtcaatccgatttggtgcgtccgcacataatcgactaaccgttcatcttctacgatatttgttccatgatcgattcgttccacttggatttcttcaatgacttggcgaatgtgttcgatcgaatcttcctgatcaatgtcgcaatgcatcgtcaaatgaaatccagcggcttttgctttttcaaaaacttttttgaacttcagtggtggattgcctttttcatccgaatcaagcccgatccccaaaatcttatctttaaaaggtagtgcttgttctaaggtttctgctgctgattcaggagaaaaatcccgtaagaagcacataattagggcacttcgtacaccaatttgttcactttcttgtgtcgctcgataatagccgttgatgacggtttcaaaagaaataccgcgagaggtatgggcttgcggatcaaaaaaaacttcagcataagtgacgtgatgttcggcagctttcttgaagtaagccattgccaattcataaaaatcttcttctgtttggaggacattcatcgctggataataaatgttcaaaaaagaaggcaaggagtcgaactgataacttgcttccacctcttcgattgttgattgaccaatatcaatttgatttttttgtgccaatcgtaatttcaaatcaggctccaatgttccttctaaatgcagatggagttcagctttgggaatttctttgataaattcgtaggttacttcttttgccataattttcgtctttctccttttaaagtaagtattttacaccaaaaacctttttttataacttgaaaagcgaacatcttgttgaatcaacattccttttattcatttttaacataaaatccccgttttcacaagagcaaaactttgctggaagatacctgaatagtccttaaaaagttgtgcgaatatagacgattttcttcaggagtttattttttacaaccaaacatcaaaaagtaatcgcttgcatgatttttgatttatgctaaaattaacttgttcgaacaagtttggttgttatacgcgataaaaatgatgagagaggagtggatcataactatgagaggacaaaatcagtcgtccggtgccaatgcgtacgcacaaaaaaatatgcgatttaaccgctatctgatttttcgctatatgacagcaatttttttctttatcaatctttattgggcgttgcttagtctggcaaattggacagtgctgggtctggtaccggtgttcttgcttttggtcgatggcgccatcatctttgaacagacacaaaaatattggcagacatcaaatcgattgcacttgactaaagttggttattggattcaaacaggggtcaacattactggtatcctttttatcctgttagggtggcaagacggatttttcccatttttgaatcttgcggccagaccgattttactggttagtctgactctgggattgatttgttgtttatatatggaacgaaaagcatggttgatcgaaaaagatcgggatagttacttgaactatctgcggacatttgagaataaaggaggaaaaatagatgaacacagaaaatagtaaaatgtttacctttctggataagtacttaatgggaccaatggggcgaatctcgcaatttcgaatcgtccgtggggtgatggcggccgggatggcttcgattccgtttacgatcgttggttcaatgttcctgattattagtgtcttacctcaaagttttccagctttagcatcgatttgggcggcttcttttgataagatccaaagtttatatatgctaggaaatactgcaacaatggggatcttggccttatatttctgtattgtttttggttatgaatataccaagatccaagcgcaggaagaaaaaatttcgttaagtcctgtaaacggggctttgttgtcaatgatggcattcttcatgtgtctacctcaattagtatttgaaggcggagtagcgactcttgtgacccttatttccgatgatcaaaaaatcattgatggttgggaaatggcgggtggtgtgacacgtttaggaacgactggtatttttactgcaattattatggctattattgcagtgaaaatttacgcgttttgtgtcaagagaaatatctacatcaaaatgcctgatactgtaccaactggtgtttcaagttcatttactgcattgattccgactgcgttgattgctttagtcgtgatcgtgatcaacggtgctttagtagctttagggaccgatatcttcaaagtcattgcgattccctttagttttgtttcgcaattgacgagtacgtgggttgggttgttagtcatctatttcttgatgcatgcattgtggatcgtcggaatccacggagcaacgatcgtgacctcattcttgacgcccatcgttctttccaacatggttgaaaaccaaagcggtgcaaatattgcttttgccggtgaattcaataatagtttcgtgaccattggcggttcaggagcgacactgggcatggtgatcttcatcgccttctttgctaaatcggcacaactaaatgcattaggtaaagccgcgatcgtcccatcattctttaacattaatgaaccaattttgtttgggatgcctgttgtgtataacccctatacggcaattcctttctttttggcaccaatggcttctatgtcggtggcatattttgcaatcaatttagggtttgtcaaaccaccgattgctcaagtcgcttggccaaccccaattggtctttcagggtttatcggttcaggtggcgattggcgtgcatttgtccttgcgctaatttgcgccttggttgcttttcttatttggttcccattcatcaaaatgtatgatggcaaactatttgcagaagaacaaggaaaagcttgaccgaaagtgtaagtttgaatcagcagaacccagctaaacatgtcttagctgggttttcttttgtcttcatgatattaaagaaataaagattcccactaaggcaatagcttttgcggtaaaataggagtagtacaacattgggggagaagtgaaatgacaaaacaatggacgatcgatttattagctgcagatttaatcgcacgaatcgaaaaaaaggatttagctgatcgcaacggaaagttgcctagcgagaaagaattgatggaacactatcaagtctctcggtattccttaaggcaagcactaagcagattgagtaaacgcggctatatttaccaagttcaaggcagaggctcctatgtccatgatcaattgacgcaagagcaaaaagcagtccaaagtgatcttgggtttaccgaagatcttgctagagaaggaaaactgattcaaaccgttcaatcaacacagcgtttggtctcgtacgctgagatcgatttttcaccaagccaccagcgattttctgataatcagctttttattgaagttgaacgatttcgcacactggatgatcagccgtatttgattgagaaatcctattatctggcagatatcgttggtcagatcccagaatctgctatgtacggttccatgtttgaatattttgcacaagaaaagggagtgactgtcagtttcatcgataaatttatccgctgtgaattactgactgctaaacaagctgctttttttggcatgaacgcggggagccctagtttggttgttcgagacgacagttacttgcgagaaggtgatttgatggccttctcaaaaatcttctatgactatcgagaaacaacgttgtttatgcataagaaattacaagattgatcctttagaagtagctcataaaatggtctaagccaccagaaatcattcacgatttctggtggcttatttgtttgaaaattgttttaaaaaggagaaagcggtgaaaatcgccttttttaaggagtttttttctgttttttttaaaagatttaaaaaaaacagaatactgttcagaaaataattcttatttcacttttttacaaaataaataaagaagaaaagatggaagcgtattctgagaacattaaaaagtttctaatttttgttaataaaaaggagtaaaatcaaaaaaatctctttttaatgatttttttgcgaaaagaggagcacaggtaataaataattaacgatggcgataaaaataaaaggtttttgttattttatttccaataaaatttttttaaatttttcatggtgttaataatttgttgtataaaaataaaaacgctataatttgcttgaataactgaatattttagttatttaatcacaaaaaagcacggaaatcgttctggcatgttgaaaaatgtaattgagatttttttcgagtatttgaatgggtgtttttttattttgcaaacgttttttgtttgtgatctctttctccggatatgtgatcatagcgaacatcaaaagacgaatgccaaagttggttggtcacttttgttggttgtatttacttgaataggaggagtaagaatgaagggcaatgactataaaaaaataatgaattcaaggagaaaaagacgcgcaataaacaaaaaatcgctactagcgaatttaacggtcagcgggatgttactgacgagttctgtggttgttcccactacattgttgtgggcaccaaagatcgcagaagcatcattggtttctgctgagatttttagtaatgtccaagcatcaaatgattctgcaacaagtgctgcagcgccatattcaaatcctggagataccaacccagtcaactttaccatcagcggatcgaatgcggtgacgcttgacgtcttaaacggtgataaagtagcaatcgttggtgtgccaaaagggctgactggctttgtacaaccaaatggcaatgcccgggtatcaacaaatatcactctgcaacttgaaaatattgccgctatccaaacactgattggaacgcttacgcctgctgttgacacattggtaggaacggtggatgctcttgtgaatcagaacttagcggatgcattagggattccagagacgattaatggctttccaaatttattgtatcaagcagcttccatcgttgatatcagtcaagtagtatccgtcaatctagatgacatctatgaacaattggatttattgaatcagttaggacaatttggacaagccgattttgaagtgcctgctggattgacagataatgaacgtgccttgattgccaatgtgaatgacggcttatttattgtggtcaaccaacgcatccaatccattttggagaacttgaaacaggcgcaaatccaagtgagcatcttgggcggagcaagtaacattcctgggattggctcattgatcgatggcgtcaatacacttgtccaagaaacagtcaacacagctaaagccactctgaatgttaccgtcgatgctgcacaagctgtgttgaatggaacgacagatcttgctgatcaaatcgcatcggcatctgttttaggtcaaacgacagttgtgatgccaacgaccgtgacgacaccaacgacttcagagctgattgcaaatggtgtgacgaatccgtcgaatccatacgaagctcgatttgcaggtactttttctcaatctaatctactcacacttgatttatttacagatgaggatggcaataattccatctggttagcagcagaacctgcagcagaacaaacggaaacaccaaccatcgatcctgttgcggctggtgataccactatcagcggaacagcagaaccagattcaacagtaacagtgactatcggaaatgaacagccagtcacagcagtggcggatgcccaaggcaactggacagctgaggtaccagaagtctctcaaggggaaacagtgaccgttgtggcagaagcagatggcaaagatccaagcgagccagtgacagtgagcgtcgcaggtttgaccgttgcagcacctacagcctccattagtggcaatgaaacagatggctatccggtcattgggaaagcaacaccgcatgcagcgatcgagatcacgaacgctcagggagttgttgtcggcagcggaaccgcagatggggagggcaactatcggattgtggttgcgccagatcaagttgcccctgaagaaaacttgaatgttacagcaattgtgactgccggagggcaagactatcgtagtggagcaacaccggttgttgtgccagccgatacacaagaaaaccaaactgaaacgccgtcgatcgatccggtgaatgccggggatcaaacgatcagcggtacagctgaaccgaacgccaatgtagtggtaactgtcagcggagaagagccagtgacggtcgttgcgaatgaccaaggtgattggactgcgaatgtaccggaagtttctgaaggcgaaacagtgactgtggtagctactctactgttggtgacaaagagccaagtacacctgtcagtgtcatcgtcagcggaataagtgtttctgcaccaactgcatcaattactggtaaccagagagatggttatcctgtagctggtcgaacaactgcgaatgcagacattgaaatcaccaatgctcaaggagaagtcgtaggtagtggtactactgatggcgacggcaattaccgaatcgtgatcgcgccagatcaagtggacccagaagaaaacttgaacgtcgcagcgatcgtaaccgctggtggcaaagactaccgcagtggtaatacaccaatcacagtacctatggaaaaaacggctacgccactcattgatccagcgattgccggggacgaaacagtcagcggaaccgcagagccaggttcttcagtcattctgatcatcaatgaagcagcaccagtgatggcgcgaattctgggtgggttgaacaccacccgtgcctttgccgcaccacttgaattaagagcggatgaagctggcaattggcgtatcaatgtagccgagctatcggaagaagatttgttgacggctactgcacaaactgatgggaaatatgtcagtgatccgatgagtatcgtcgttagtcccgtgacggttgccgcacctactgcaacaatcagcggcaatgaatcatctgggtatccggttacggggaaagctgatccaaatgtaaccattgaaatctctaatgctcaaggagaagtggtgggcactggtacgacagacagtgaaggcaattaccggatcgtagtagcagccaatcgcgtcgaaccaaaagataatttatatgttgttgcgagtgtcgttgctggtggcaaagaataccgcagtgcagctgctacagtcacagtaccggttgctggagttgacgacggtaacactggcggtggcaacactggtggtggtaacactggtggcggcaataccggaggaaataatatcggtaatggcaataacggtggaatcaatatcatcggcaatgggaacatcagcggtggcaacaacatcaatagtaataatagtggaggcaaatacttgccgaaactggcagtgaaagtacttggtttgcatcaatgatcggtgctgcactggttgcgatcggtagtcttggtttcttcaaatcaagaaagaaaaaaaatcagtaactgctgaaactggaccaaagcaaataattgctgatctataagagaaagctcttgcgatgtgtccatgtcgcaggagcttttttttagaaatgttcctgaatctatatagcctttctgctgcgttaccaccaattctactaatggtttgaagagttacgaaaactgagagcgaaaagaatagagaagttaatagaaatatgcagatttaaacaggaattttttcttttttgactatccatgctacactaaattttgtagtaaatggaaaaagctttcaatcgtttggttacgcaggttgcgtgattggaaggcaaaaggatggtgtagaggttgataggcgacaaaggcaaggaagcacgtgtccatcacgtttttgagcgtgttgcggagaactatgaccagatgaatactgtgatttcttttcaacaacataaacgctggcgaaaagatacgatgaaacggatgcaagtccaagcaggtaatgatatccttgatgtctgctgcggaacaggagattggacattggcactggcagaagcaacaggatctactgggaacgtgatcggcattgattttagtgagaatatgttggctgcggcaaagaaaaaagcagcggagcaaaagacaaagatcgaatggatgcaaggaaatgcaatggcacttccttttgcagacaatacgtttgatgttgtgacgatcgggtttggtctgagaaatgttcctgatcttgtaaccgttctaaaagaaatgcagcgggtcgtaaaacctggcggaaaagtggtttgtctggaaacatcacagcccactttaattggttggcggcagctgtattatgcgtatttccgattcattatgccgctgttaggaaaactgtttgctaaaagttaccaagaatattcttggttgcaagaatcagctagagattttcctggcaaagaagagttgtctcactactttcaatcagcaggactgactaatatagttgtcaaaagctatagtggaggtactgtagccatgcatctcggatataaaccaaccaactgaatccaataaaaagcatgtgttgacatagaagctgttaaagggatgttgctgagaaaatcagctcattttcgaaaacaaagacgagtgcttcagatcaaaataaaaaccaatgtcagttcacactggacgttggttttttgctgtctatttcactgtgttcattttgcgggtgcttattgttttccggtattttttaaaacgatattggtgtagagccataccgttaaaagataataaacggcataaagggcaacaaagatcgcaaatggtaaccagatctgatcatagggatcactcaatagcattttaaacatttgcagtccgaatagtacgtgaacgattcctaataatcctgggactaagaaaagcacgccgatctctttgcggatcgattttttcagaagcccattgcgagcaccgatttttctaagcatggtgtagcgcataatatcactattagcccctgaaaggattttgaacatcaagcaactagctaacattgttagaaaggcaattcctaagaagaagcccatgaattcaaatcctgagaaaatgccgttgaatgtgtcataagcatccgctcgttgcataagattactttctcctgctaaggatggattgtttttttgatccagcttagcaagtgctgttaattttggcaggacagcttcaaagtctttgacttgaatgacttgtaagatcgtttcgggtgcgttcacttgttcaaaggcattggcagaaagcagcttgacttctttccctcgctgttctggcaattcaaagctgcgcagctggtcctgttctgcaagatcagctgcgatcgcttggccatttagtgagcggtaaccatctctctgactaagatctccctgttctgtaacgatcaaaggatctttgtcaaattcttcttgaatgtaataaacggctgtgtcatcctctttttggcgatagctgacattcaatgttgggtgtaaatccgcaattttttgttggtcgacagtttgggcattattcagaaccaagtcataagaggtcatcgctttggccattttagggatttcatttctgaaaccaaggccaacggttaatgcgcccagtgctaatgcgaacagcatggatactaacgaaagcatctgcgtatagtcacggatacggaagtttaactgagacaaagtgaaattattcaattttttcagtgcgatggcatctgatttctttaataatgtcaaaatcaatacgatcacagagcggaaaactagataggttcccaaaacgatcgtgactagggcaatcgcaatacccataatttgaaatttcattagatcgctcataacataataaccgattccaagaaagatgatccccaaaagggtttgaaccaataagaatgggaatttttgcttgatttgtgcaggtgtactagtttctctcaacaaatccaagatggcttttttggcaatggctgaagcattgacgattgctgcgatcaggaagagaatggcaaaaaagaccagtgtgatcacaagtgcttttacattgaatggcgaaaaatgagtaatctttatatttaactgttgtactaaaagatcattgacaattttcgtcaatccgatacctgctaaagcaccagtaatggttgcaataatccctacaaaaaatgtttcgatgaagatcatttgggcgatttttcgtccttttgctcctaacatcataaacatggcataatccttctgccgcatcgacattaggaaagaattggcatagagaatgtaggcaaatgtgatgattcctagtaagaccgttccaaagtgaaagataatgacaacgacaccaatcgttgaattgtttttcaagaattcttcattactagccattgattgaaacatataaaagatggcagaagccataaccagaccagaaaacaagacgatgtagtcttttaagcggcctttgataccagtaagtgataatttccaaagcataccattatcctcctactgttccagatttcctaagatgactaagatctgacgataaaagtcttcttgggtttgattatttcgtttgatttcttgatggatcttaccatctttgataaataagattcgcttgcaataacttgccgaaaggggatcatgtgttacgagtaagatcgatacttggtcatttttgtttaaatcatccatcatgtctaataaatccttggcactttttgaatccaaggcacccgttggctcatccccaaacaagatcgttggttcggtgattaatgctcgcgcagcggctacccgttgcttttgaccaccagagatctcggaaggatatttatccaaaatttggctgatggataagcgattcgcgacttgttgaatgagctgtttgatctttttcggccgtacgccttgtaaagagagaggcacagcaatgttttcagaagccgttagattttctagtagattgaaatcttggaagataaagccgatttctctactgcgaaaatctgccaatgcatcaccgcgtaattttgtgatatctttttcgttgatgcggatgtttccggaagatggatggtccaatgtggataaaatattcaacaacgttgatttaccagaaccggaagcacccataataccaataaactcgcctttatcaatcgcaaagctgatcccttttagggcttcggtttttttctcattatttttgccgtaaactttcgttaattcgtttgcttcaataatttttgccatttgtttatcaccgttcactttctaattgtttcaacgctttttcaggaatagcattcttttgcacttcttcataggaagtcacgcccttgttttgattccaggtaatttttaagtaagcgtcttttttcaaaggacgatctttcatccctaagaattccagatttttcttctttgcgtctttgtcgtaaccaggtagttcatatttatattcgatcacttgattgcctcgatcgtcttcggtttcgatcttttcgccatcggtcgtgatctgaacatagtaactttggccgcccatgatgactttctcagcaatttgtaacccggcaaacaaaacgatcattaggatacccaggccgatccaaaatttcttcatctattctcacttcctttaatttgtaaagtctaaagagaattatagcgggcgtaaaaacaattgtagtgtgaaaaacctatcaataaactttcatttttgtcatgaaaacaatttcatgatgccctcctttgtattgggagctgttaaccaaaggttcaccttttcaacgcattccgtgtatcaagagaccgttgtaaacgaaaaaccatgggacctccttcatcaaagagatcccatggccttcaatatttttttcgaaacaatgtaatgatcaagcgatccttttcgtaactgattgttgcttcatcgatcaacaatcctaataaataaaagtctttttcttcatgaatcgactggttcccgcctaaaagttcaatataataactttctagcgcaatctctcgtggggtattcaacatttccgcaaatacggctaaatcactgggctcttctggacaggtcccagcaataatggctcgaaaacctgttttttcgaaagacatctcagtagtgatatgagggcagtcgtgggaaagaaagtaggtgaccacttcatccacgatccgccgtgcttgttccttttctatcattggttcatccgccttttgatttggttgatctcatctaacaaaggtaccatagctgccgccacaaagccactggaaaaaccattattataaagattcaacccgccatgtaagtaggtaatattgcttactaacgccgcatgggcaataccggcaaagattcctgcaattggtccatagtagccgctgattggtgctaaacttgttccaaaaatcgcagtcaacagcaattgaaaggtcgaagtctcagtggtaaagcctaaacgtgtggcaagaacgaccccaatcaaaatcggcagactatttttccagtgatttccgaaagcactaaagccaaccactgtcagaacagcaccaagtaatgggcctgatagctggcccccaagcaagtagatgaatacaagcagcagcatccccatgatcgccatgttcatcagtgtgacccctaatgcaaaaatcgtgacgaagtctgtcaccagtttaccggaaacatcgaatagatgagccaatccttggaaagaacggtgattcaataaataaccggttaaaaagagcaacccgcataagccgcacaaaaagaagagtaaaaaggaactgtactcagtcgtcaaatacggtagatagtcaccaaagtcagccagatctgttcctacaaacagcatctgattatgaggctctccgtgacgcgctattaacaataaccgcaaaataaatcaaaggaccacgaatccttaaggattcgtggtcctttttttcaaaaattgcaagaaaaacgcatttttccatgaagtgagcgtttcgtttttcatttcatgaacattcctctacacttttaagtaaggtcatggttctacatgacgagcatgaaaaaaataaggaggaaatgaacatgtcaaaaaaaatcaatgatccattaacgaagtactataacggcacatttgaaaagcaggaacaggaagcaccagcggtccaaggaaaaatgcagccagtaccagattgtggtgaaactagctacaatggttcaggacgattagcaggccgcaaagcattagtcacaggcggggattcaggcatcggtcgtgcagcagccattgcctttgctaaagaaggcgcggatgtggctatcaactacttgccttttgaagaagaagatgcccaagaagtgaagactatcatcgaagaagcaggtcaaaaagctgtattgattcctggcgatttgaaagacgaatcttttgcgcgtcagttggttcatgatgcagcgaaagcgttggatggtttagatattttggtcttgaatgcaggtatgcaacaagcggtcaaagatattaaagatttgaccacccaacaaatcacggacacatttacaacgaatatcatctccatgtattggacagttcaagaagccctggattatttaccggctggcggcagtatcattaccactacttccatccaaagtgcagaacctagtgctcatctgttagactatgcagcaaccaaaggagcgatcacttcatttagtaaaggattggcagcacaattgagttcaaaaggtattcgcgtgaatactgtagcaccaggaccaatctggacaccactacaaatttcaggaggacaaccacaatcagcgatccctgagtttggacaaaaagaattattaaaacgggctggccaacccgttgaattagcgccagtttatgttttcttagcgtcagatgaagccagctatgtcacaggacaagtctatagtgtaacaggcggaagcttctttgcttaaaacccgttgttaaaaaacgcttacgacaataaaaaatgcgaagtaagaaatacagaggccttgcattgctttagcaaggaacccatctgatatttcagcttcgctttttttatggaatcatgataaaaaatttgtttcaacaagaggatttgcaagtgagggcaaacatttttttggtaattacttgattgatttttgcaaacaaagattcccattcatacatattaagtatatctgagagtagcagaagcttttccgttatcgctacttcttcgtaattgtcggtaataatcaagtccgccccttcgatatctttagtgaatgagaccgacttctctgagtagatggatcggatacgggcttctatcagcattttggttcgatattgaatcgttgttcgaaagtaaatccgaatagttggactttcatgcatggtggtttccagatagagtagttgggcaagataacgcaattgtttacggtgaaagaattctttgtctaaatcattgtttggaaaggtattgacatgttctgttaacaagtgagcaattgctgtataagtttgactattgttgtcaatcgaactttcatcgggcaagttatagtctaaattccaaactttcagcaaatcaacatcgataaaaatcgatagattaaaaaataagagacaactgtttagaagttggtcaaatgaatcttgcttcatagtcggcacaaatttttgtcgccaatcttcgatcatatcaataaaaaaatgaacgagaggcttttttgattggtaaaccagcgcaatactctcttgaatcttttggcgatcaacaactgcaggaaggaaaatatgcaaaaagaaatttaaatacaagtattcggcttgagcgatccgtttatctaaattagttttggagaaaaagaacgaatcgagaacttccatcggcaaaaaggagtaaaagttcaagagtgcttgagcttttttctcgatttcaggcaaatatttcttttgagaaagtcggatggtaattgttttccaaaaggcaaacaatttatttttagtcaactgatctaagagagtagcatcaaaaaagctgttgaattgctcgaattctgttatatattgatcagataaaagctgaaactcggttggtgcactttgcgtaagaaaactataaataaagatgcggatatccaactctcttccagcaagttcgacaatattttcttcattggaatagattgagaggtaaaatttctttaatattagactgactttttttatcagacgatacatgtgagattggctaacgtgaagatccgaacataactgggacattgaagaatctgtatgcccaataaggtactgaaccagttgatattgtggagaactgagcaagtaatgatagaccagcagtgaataagaaggttcggcactatctccatttctttcgatacaatattggttgtaggaatttttggcgagacaaaggttgacggacagatatttcaagtcttcattcaaaaagtagatatgtttttgcaagcttttgatggggattttcaatactcttgataattttaataagctgattccattggtgttacatactgctttgaatatatcaagctttttttcctctgcgggagaaatgaactctcggtacatcagtattctccttttttgctccatttttacgcacaatatgaagcctatttgtaaggttttgtgatccgtttttttggtacttttgattatactaagtacaaatgagaagtcaatgtgaggcgatgaagaaacaatcatttttttgtggttgaaaaaatgaaagtattgccagaaaattggcatcttgtttaataaacaaaaaagaaggaatgacttatgaaaaaaatggtgttggcattaggtattttaggaataagtagtttaggggtcccagtgactggtttagctgcggaagcaaatccatctacttcaatgaccagtgaagcagcactaaccatcaatccagggattttgtcccttggtagtgtttcaaattttgattttggtactgggaatatcgcagatttcgctcaacaagagaaagtgatcaccacggtatcaaatgaaacgtcatctgtttctgattttcgtggtccaaacacagttggttggcaattaacagcaaaattatcaaaaatctcgaatgccgatcaaaaagaattagcaaatgcaaagattacactaaaaggtaccgaaacagcaggagatgcagctttatcagcaaatgctgaattggttgctggagctaccgatcctacttcagtagcaaccgcagatggcgcaactgggttagcaatcaatacctttgatttttcgaccacaacgttgaccgttccccaacaaaatgtttatagtggtgactatacaggaacgattacgtggacattatctaattcttatcaagcacagtaataggatggatgacaatgagaagacttcttcagaatgcagtatggatctttttatttatcagctttgtttattttcctgtgactagtggttatgctgagacccccagatttactgttataccagaacttccccaaaatcaagcaagtgaagcaacttatttcgatttgctggtaaataaagagactgttcaggaattgattatcgccgtacacaatacgagttccgaagagataacgatcaccgctgatgcactgaatagttattctgcttccactggaatcatcagttatcaacgaaagaaaacggccgaagactatggaggtaagtcttttactagctttgtttcaaaccccattcaagaagtacgcctaaaatctggtgaggaacgaaaggtgatttttacacttgatttaaaggaaaaagtgtttgacggagaaatcttaggggcttttttgttcgaagaagtcaaacctcaggaaactgctcacgaagctgatgcaagtttggaatcaaactatcagttgcagttaggggtacgaatgcgtcaaagtctacaagagctgccaaagccagatttaaaactagttgaaactaaagcagtcgaaaaaaatggcaagccaactttaaaaagcagtatcagtaatattcgtcccgtcgcatttgggaatatttccgtgaatacgacgatacgtgacaagaatcaagctatcgtcggtggctttaagtcagaaaattttcaattcgcacaaaactctgtcttagatctctatagtgaatttgaacaagaagaactcaaaccgggcacttatacgattcgcatcgaattatcctctcagcgaggcacatgggtttttgatgataaggtcgttatcgatcgtcaagcagcaaaagctgtcaaccgaactacgatatatgcagcggctatcgctcaaagaaattttctgttctatctattgattgctttaatcattctattgattgcaatcatccttttcttgttagtgaagcggcgtaaaaactccgatgaaagtgagtgagaagaatgaaaaaaatgctaaaatctttttgtttatcgcttctttttataggaactttttggctgttgcaaggacagcaaacagtctttgcggcggtcactgcgccggactttgctactttaccaattaatcaagtaatgatctctactgcaggtaaagcaggttcattgcaaggtgtagaagggcataactacgttcaaatcaatgacacaaccataaattctagcggggcagtttggttcaacaatccgacttctttcacacgagatttccatttggaaatggctttctatattgagaatacggctaatgatagcgacggactggcttttgtgttgcaaagtagcgggcctcaagcactagcttcagaagctggatcaacaattggagtttggtcgaatatttctggatcagacccacttagtcaaggtgcaatcgcaaatagtatcgcaattgaatttgatacatattacaacaataatggcggtatccttgctactgatcggatgatggatcgtgatgtgacaacaaagggacaccatattgcttggtcttaccctggttccgatgcttcttatacgacagacggctggctgatggtggataaagtcttaaatcactataacacggttggcgttacggacatttccgatggaaattggcatacctttatcgtggattacaatgaatctacgcaacaatttcattatgctgttccagattttaatgtagatgtatcgattcctgtcgatgatacttttaaaaacaatcttaatttaacaaattcggcgccagtttattttggttttaccggtgccaatggcggatttgcccaaaacaaagcagtcgctttcgtcgatgttcaaggtctagtcgaaattgatatgcggacgggcgtcttccaaagagagccagatcagtttatgctggacacgggaacagtaatggataaaccaattgaagtggatgcaagtaaagagattacttatgcaacctatattgattttaaacaaacaagcgatctatcaagtttgaatccagggattaaactcaaactcacacttccagataatgtatctgtgaaagatactgtctattttggtaaaccagaagataccatgatcaacggttttcctgatggggggtccccaatcgaatatataagagagacaggacaaataagtgtagtattgccgaaattggaaaaagggaatgcctatattgttcattttagggtcaagtatagtgggacccctatagatgcgaatattgatgaagtaataccagttgagactacctttagtggaaatgcttttatatccagttttacttcaggaggagccgctacccatttttatacggtaaaaggcaaattcccaccaacattgaccagcggacaagccacaatgtcagaagcgcagaaaactgcgccgatccttcgacaaaatcgaaatgcctatactgacatctctgtggaagatagtaattctacgcaggcgcaattatttataagtgatttattttcacaagagaaggaattacaggaagaagactttactctaaaaacagttcttgaacgaacagatttgtcagatcccttccactacactttagagtcagagacgagtgatctttccccagggactacctattattttgcaacatatgtcgtcgacacagaaggcaattcatcagcaatccattactttgccattgattttcgaggaatcatcgaattaaaatcagtcccagaatctttcaaaggaacaacagtcacaatcaacgagttggctcgagcaatggattctaatggcttggtaccaataaaagttccaattgcaacaaccagcaagcctctcgcaatcagcaatacgagtgaaggtacatggaaattatcgggacaaaccaccccatttatgaatagtggcgcctcattggctgatgaagtccaactagttctatacgattctactgataattcattgttttgcaccattacttcagataaaaaagtactttttgagcagacgcctagcgataaagctctctctctcgatttaagtcagtatgattgttatttacggtttgcccctaagatagagaccctttccccaggaacctatcaaggaaaagtcaattggcagttagacagcacgatcacagactaatgcacgttggtcagaaagacagacaaaaaaacgccatttcggcgtttttttgtctgtctaaggataagaactcagctttcccgatctttgactacttttagtactaaagaaagggcggccaaggcaaaactgccatacttgacaaatttctcaagtgactcgattttttgttttttgctttgtttgcaagcagcacatttcgtttcagcaccatctagtttttttccgcacctacagtgttttttcatttgatccgtctcctttacaattttatcgatgtttcatcaatctcttactatcaattatacatggacaacgggtttatgtccgagataacgctgttctcctcgcaaagcaatcagtgaacgcggataggctattttcttgggtatgaatgattcgggagatttgacgtgctaccttaaaacaccagcagtaggtttatctacaatgaggcggatgaactttgaaaacggcttgaaagcctgctacgttaacgattctctttctcatttaacggttttttgtttcatttcattcctgcaagtggtacgcttttggtgaaaggtgaggtgcataaaatgaatcgtttaagtaaatttttgattgccatcggcgtaggagctgcggcgttgatcgctgaatttggctttgatcgacctcccattgcttttggtttgatcgcgatcatcggcggattgacagcgttgacgatgttgatcgacatgatccaaacattgcgttcaggaaaatatggcgtggatctgttagcgatcacagccattgttgctacacttgctgttggcgaatattgggccagtttgatggttttgatcatgctgacaggcggcgatagtttggaagaatacgccagcaaacaagccagccgagaacttcggcaactgttgcaacgttctccacagaccgcccatcggctgaatgataaaaaagatgttccggttgaagaactagctattggtgatctggtcatcgtccgcccgggagaaatcgttcccgtagacggctgtgtcactgaaggaaatacccttgtcgatgaatcatccttgactggtgagtcacgacctgtagagaaaaatcctggtgatgaattgatgtctggctcagtcaatggggaaactgcgattacttttgaagtgacgaaaaaagcagcagatagccaatatcaaattcttgttcgtttagtcaaagaatctgaagcaaaacctgcgcgctttgttcgtttagcggatcagtatgccgtaccatttacgttggcagcctatgtgattgcggggattgcttggtttgtatcaaaagatcctgtccgctttgcggaagtcctagtagtggcgtcaccttgtccattaatcttggcagcaccagtagctttagtagcaggcatgagtcgctcaagccgcaatgggattgtcatgaaaaacggcaccacgatcgaaaaattagccaaagcaaaaacgatcgcttttgacaaaacaggcacattgacagagggaaagttgcacgttgaaaaaataactgtgactgctgatcaactatcggtcgaagagcttttgcgcattgcggctagtgctgagcaggattccactcatattctcgcccgctctctggttgcttctgctatggaacgaaagctgactttgctgccagtcaccaacttgaaagaagtggtagggcaagggatcgaagcaacagttgctggacacaagatcaaaatcggtaaacctgaatttgttggagcagttggtgtagatgaagctaaaaccaatgtttgtgttgggaaagatgaccaatggataggaacgatcttttttgaagatacattacgcaaggaagccaaacaaacggttgagcagttgcgtcatcaaggattgaaaaagacgatcatgttgacaggtgaccaagcattcgttgctcggaagatcgcagctgaagcagggatcgaaaccgttctagcagactgcttgccggcaaaaaaaattgccgttataaaagaaacagaaccagctgaacgcccgatcatcatggtgggggatggggtcaatgatgccccagctttagcagcagctgatataggcattgctatgggagcccatggtactagtgctgcaacggaagcagcagatgcggtaatactacaagatgatctcagcaaggtctctcaagccgtacagatttctcaagacacgatgagaatcgcccgccaatccgtgttgctaggaatcttcatttgtatcgttttaatgttgattgccagcacgggtgtgatcccagcgttgtttggcgctttgttacaagaagtgatcgatacagtatccattctatctgcacttcgtgctaagaatgatcattctactagcacagcatcatctctttcagtcaatcatcaggcacattaataggtgcaggtccgtgactaagagcaaacaaacctgataactgtgatttttgtgatagcagatgcaagacacttagattatctggctatgtttgccttataagttacgggcctttttgattcttaaagcaggtccgtaaaaatcctccttttttttaataatactaccgttatatataacgaatttttcttagctaaaatcattgttttgttgagtataattcagcttcactcatactttgtgatgttattctcatttttttcttcgttattccctcaaaatgagaataattttagccgattttatgatatatatatacgtaggaagtttcagtagattgactgtgaactgtccgcatgaaaggattgataattcgcgtgattgatttaatgctctataaagaaacagccgactatttggagaaagtgatcgataaagaggtgcttgaccttgtggaagtagagtaccctaaggtatatacttacatccaccaattgattgattctttcaaatgtgctgtccaacaaatagatggttcaaatttttgggaactttttccagaaatacttgggtatgattcacggtttgttttattgaactcattgattctagtaagagatgaattcttgacagaagaagaaatcatccaaatgatcgaaaccgattatactcatttaaataaagaatcttgcggttattctttgaaagatcaggaacatgaaagccttatcttcaatatcaaataaatgatttcctaaaatcgcaaggagcagccgaccagcatcagtggtcggctgtttatttgtttaaatttacgcttagtttattcaataatcttaaaaatattttgaaaaaatggtaaatatagattattattgatgtatgaatgaagaataactgaaaagtcttttcaattcagcgttacagttagactggattcaggaaattagctatataacattgttcatggaatgagcaaagagaaaggggcatatatggattatttgaatttttcaaaaaaagagtgggagattctgatttgtttttggaatgctcaggaaccactatgttgcagtgattttagtgagcgttttaacttgaatcgcaacacttcgttatcagtcatcagaaaattagtcaataaaggcatactggaagttgcgagcatcaaaatgagcggttcggttttagcacgtcgttttcaacccaaagtgactgaattagaagtactgcagtcgattcttaatcaagatcagatttttgctatgcttcaggtggcgattggtcgtctcgaagaaaagcagttagcgatgttaatggacaaaattactgccaaaaaacaagagctttcaatgccaaaagaccatcagtgatcttgcttgtccaaagagagccaacaaaaaaagatctgacttatggactgcgcttaagaagttagtttttcggctaacgtttcgagcaatccggtaagtcggatcttttttagctagttttctgaaactgatgcagcatttttgtcgtcaagcgatgcaaatcagctagttctgtaggagacaatggcaggaagtctttgactttactgggaatattcaccgcagaatcatggagcagctgcccttttcctgtcaatgacacatttaaagaacgttcgtcctcttgattgcgagttcttgaaagatagcctttcatttcgagtttctttaaaaccggagtcaaagttccagagtccagacacagggaatcgcccaattcttttactgtcaatgttccttgctcccataagacgagcatcacgagatattgcgtataggtcaagtccagagggtccagtaatcctttataatgcttgataatttctttcgaagcggcgtatagaggaaaacatagttggttttcaagtgctaagtcattcatgtcctcactcctttttatactgacgcttcttatcatagcttttttgtatcggaaagtctactcactaacagctttgacggttacttcaatattgccggctgttgcttttgaataaggacatacggtatgagcaatttctagtaattcttgtgtttcatctaatgaaagaccttctacgaatccttcaatctctactcctaaaacaaaactactttcattctcggcataaagtgaaacttgtgcacttacagttgatgcgccatcaattcctttcctttgctttacaagttcaagagcactgttgaaacaagcactaaaaccagcggcaaaaagttgttctgggttagtggcattttcgacccgtttaccaggtgctgcgatggataattcgaaggaatgatcaggactatgaacttctcctgaacggccacctgtgttgatcatctttgtagaatacatttttttcatctaacttcactcctgtttttttgattttgtacaattagattgtatgcaatttaattgtggaaagcaattaagttgcttgcaaaagcaggtttttttatttttacttgtttttacattaaattgaaagtaaaagtttaaataattactgtgtagcaaggtaaaacatgatatgatgatagcacagaatctaaggatagttagttagtgaagagggtgactaaaatcgtagaatatatggaaaaccgcgcagtcgggaaatattttcgttccacgacagatcattatgccggattcattcgaatctttggtacgtatactgaatatcgggttgttgccggtattccagcagagaatgtgatgctggagatcatcggcgttgaaaatgggatcttgctgacacaagtgaacaatacattatttgaaaatggaagagggtatattcaatgatcatcgtacaaattatgttaatcgttcttgtcatagcgatcgcgatttggctgttggcaagcactgctgttatcgttcgacaaggtgaagtaaaagtagttgagagttttgggaagtatgttaagacacttgaaccaggtctacactttttagtccctattttatatacagtcagagaacgagtatcacttaaacagattcctttagaaattgaaccgcaaagtgctatcacgaaggataatgttatcgttcaaattgatgaagccatcaaataccatgtcacagatgtccgggcgtttgtttatgataatgaaaactcggtcgtttctatgatccaagatgcgcaatccaatttgcgaggaatcattgggaaaatggatctaaatgaagttctcaacggaacagaagaaatcaacgtggcgttgtttacttccattaaagatatcacagcggggtatgggttggcgatcgaccgaatcaatattggtgagatcaaagtttcgcaagaaatcattgaatcaatgaacaaactgatcactgcttcacgggataaagaatccatgatcacgcgggcacaaggggagaaatcttctgctgtcttaagtgcggaagccaaagcttctcaaatgacgatcgatgcccaagcccgagcggaacaaactcagattgatgcggaagctcgtgctaaacgtgtacggatcgatgcagacgccgaagcagaacgaattgctaaaattactgaagcagaacgtaaacggatcttagccatcaatgaagcaatcaaagaaagtcaattagacgaacgttcactctcttacttgggcattgaagcctttaaagatattgtcaacagtaagacgaatacagtcattctaccatcaaacatgacagaattaggcaatattccagttgtgaaacaactctgggaacaaacagacaaaaccagcgaataacaaactaactgaatcaaccaacataaatgagcttcacccattgtttgataaacatgggtggagctcgtttttgatttgttgaacaatagtttgattactggatagttgttgtcttattggtacttgtggcgcagtctttttttatcctaaagagaagacgtagtaatagttcgattgtctactatcaacaatgcgatcatcacataaccgatccaactatctctggaatagagaatataacgaggagaccaataagctgcatacttgctcttgtactcccgcaatccctcaaaggaataaaagtgagaaccaaagttatagatcaaataggcgatccgttcttgaatgaaactgcttctgaacgtccctacattcgccagcggggccatccctaagtcgaactgttcgaatccttggtttttaaaataatcgaagagattgatgaacaaaaagtccattgtgccattaggtgctttttcaggatcatgacgcattaagtcgattgacccacaacctgtctgataagtaggcataaaagaagcaaatgccacaatttcttgctgttggttcttgacgacagcgattgggacggtgctcaagtaatcttcagagaaaaatcctaatgagaaacctttctctttgcgaccatctagccagcgatcagaaatatctcgtagcttggcaaatgtttccgcattgtacggtggttgtaggacatcgaaagtaaagccttctttattgattttgttgtttaatgcccgttgacccttcatttttttgccagacaaggtgaaattctgtaggtccacgaaggctttctcaccaaatttgatgaagtcatagccgaattcatgaagcagcatgaccatttcttcactgctttcatagaagacaggcaaataattccactgatccatttctgtgataaaggcttctagtgcagcagcaaaatcctcttgcttaccagctgggtcccccatgaccaaacatttattgttataggtcgtaaactggaaaaagacggtaggatcggtctcgttcggatagaaatagacttctttatctttcaaaaagacaagatggctatcactagtaccaccgtaggtctctaaaagagtcaagattttttcattctcaggtctctgtccaatttgatgtttgggtcccattaaatagcgtgagaaaagcaagaccgcgatagcgacgatcatgatagccagaaagccttgcaaccataacttttcagaaggaaacaaaagaaaatcaatggaacgatgggcgggatgacgatttaaatggggcatgttatagaccccaataatcacataaaggacagtcaaagatcccatcaaaaggccatcgatcgtcagccattcccaagaataaaccagttgcttacgaaatagttcacttttggaaaggaccataatcgccaataagaagagcaagaaacacatggttgaaaagcggaaaccggctaagaccgcatagccgatcgttgctgcaatcaacagcaatgttggaaaataagcgcgcgaaacacgagctgaaaccccacgaccagcaatgatgaaaagatagcctaagaaaatacttgggtattgcatgacaaaattcaaccgtatcggattaagatgggctaaccattgaatgtggtcaaatgcttccggaatcgttgctgacaaaaccagcatcgtaccagtcaaatagagcaacagtacttcaatcttatggaatacttctaaaagcaatcctttaggaataccagaaaagcgtgtgttgagcgttacactgacatttttagagaacaaaagcaccccaatcaaaaacggaatgatgtaatagaatagccggaatagcagaagccacgctacgacgctttctcggggaatattcaatgaacccattcccatgatcatcatgacatcaaaggttcctaattctccgggaatcattgatacgatccctatcacagatgcagcaataaataatggcagtatttgaaaaatatccacagagatccccatcagcataccggtggtgataaaggccgtaaatacccctacccattccaataatgaaaccaaaatcagttgaccgcggtcagaaggggtcagaccgcctaaatagccattcttcttcgacaaacttaagacatagaccactggaaagtacaaacttcctcccaatagccaaatccaatattgctgcagataatcagttgttggcccaaagacgacgaaccctaatgccagtaatgataaaagcgataacccagacatcagataaataaaaattttcgaaattgcttgagcaacatctttgccatttttttctttgccatagaattcggagcgaagaccaatgctgataaaaccgccgaatcctacaagattattcatggtattgatgatccagcttgtttcacttaaataacgggcagaaagcttttgtcctaagagccgatttaagataatgtcataaccaatcattggcgcaatacaaagcaaactaatcaaaagcatcaatgcaacacgccaaaccgctaattcggaaaacagtgtcgtcaattgatcgacggaaatcgtcttgcttaaggaaagcaattcacctaaaacgatcactgctacagcgatcaaaaagagtcctttgaacaaggagagatggttacgaatccatgtaaaaagtttcattttattgtcccaccttatctaagaaagaaagaactttctgattgaatatatttggatttttgcgagcaaaactatgtccttgtccctttactaccatgaaattggcattcggaatatgattggctagataaaatgaatgagacaatttgattgaatctctttttcctaccaaaatcagtgttgggacagtaattttttttaaatcggtggctgataaaccgatgttacgaaagagtagtgcaagaatcggtaaaaaaccacgcatgcctttatcgaaaggcgcgcaaagccaaacgactgcatattggatcagactgccgatccgtgcaaacagccgaacccctttaggatccgtattgccggaatttaaaatcagacaactcactaattccggatatttaaaacaaaacaccatagctaaatttgcgccatcactaaagcctagaagagctacctttgacaggtgttctttttgaataatggcatacaagtcatcagccatcaagaaaaaatcaatttttttgcgggtattcgttgatttgccatgcccacggctgtctatcaagtacagctgatgtttctgacttaattcagctatctgattagcaaagtaagcactgctcccgccattgccatgcaataagaataatggcttgccttttccaattttctcatagtaaaggaccgagccatcttgcattttggcataacacttttcagattccattttttcacctactttctttgagtataccttgaagcccgcgattgataaaatcaaatggtgatttttcactagaaataatcatcgtttattcatttttgtcttagaaaactgctatcatattatattaagaaatcagacagatgctgctctttagattcatttctagccatatcttaggagatcacttcgaaatggaacagaaaactttgccaaaatagaaaattttcacattttcccccgtatttttccctcttatttctttagaaggaaactatagaagagaactatagaagaaaaccatagaagaaaaccatagaagaaaaccatagaagagaactatagaagagaactaagcaaagcagcaaggataccccatagtgtctcccattcagtgacaatggttttcattaaacgggggaacaatgaatgatttaaagcttgtttaatatgtctaaaggaaatcaacaaggtgccttctgattttttttcattcagtttgacctgcaagatgcattcgtggcgcagaaagcaaatgtttgttattcctaaaagattatatctctccaataattactgcaaagtttcaggaattcagttattattttcaagttgttatcttgatgctggagggaaataaatgagagagactagatatgaagaattgaagcgagcagaaaagggcgctctgcttagtatcatcgcctatctattgatttcattcgttaaattattgatcggtaaaatagctgggtcggaagctttatgggcagatggtttaaataatgccaccgatataatcgcttcagtggctgttttgataggtctacgcttagctcaaaaaccggctgatgaagaacataagtatggacattggaaagcagagaatgtagcaagtttgattacgtcattgatcatgcttgctgtagggctgcaagtactttattcctctgtctggtccttgattcaaggggagacagaaagtcctgatgtgcttgcggcaattataggtgtggtctcggctattctcatgtatggtgtgtatacctttaatcgaagattggctgcacaagtaaaaagttccgcactgcttgctgctgccaaagacaatcgcagcgatgcttggaccagcatcggaaccgccattgccatttttgccgcttcttttggctgggggtggcttgatagtctaacagcgatcgttgtcgctgttctgatcctaaaaacggccattgatattttcaaagaaagtgccttctcattgtcagatggttttgatcaaacattggtcaacgagtacgaacaagtcgtagccgattttccggaagtaaaatctgtcaagagtattcgcggcagaatgtatggcgcaaatgtgtttcttgatattgttattacgatggacaaatatttgacagttgaaaaaagtcatgcagtagctgatgccatagaagcattgctgtctgatcgtttcaatgtctatgatacagatattcatattgaaccagattaatcgccgatttatttttaagggtcattttgtgttgtgtaagttaaaaaaaacagtgtaaacaccacgtttctagcatgtaaacatcccgttgcttctttttttattgaaagaatggcaaactattcttatcagaaaaagaaagtagggatcgtatggagacgataaatatcactgaccttcaagcaaagaaaattaatgaagtgggacaacctgtccttttagaaatttgtaaaaattatattttatcagtagaagatagacagatactagctcttcttcagaaacaaattacagaaaaaaaagctgaactcgtttgagattcaactcgttttagtcaagtacaaaaagaaaagcagcagtttgatccatcaatgatcaaactgctgcttttttagcctttgagaaaagaaagaatgaaggtaatccaacttttcttttgtaagagaagatcagtagtctgatgatatcctagaggaaagcaaaagtagaaataagaaagatttcggtagaaagaagtgattcgattttataaaagtcttttaaaagacttcaaaaaaacttttttgaggttagtgaccgctagtcattttaatgcctacaatactgatcaataataatccaacaaaaagccaagtggctgggtttatcttgtcatggaacaataccacaccaatgatgactgaacccaccgcaccgatcccagtccagatagggtaggagaaactcattggcagttgtttgattgcttgcgacaaaaagaaaaaactggcgatcataccaataatggtgtaaatcgtaaaattgatttttgtaaatccttcactccatttcatcgttgtggaccagaatacttccagtacgccagctaataatagttcgagccaagccattctatttccctcctttttgattatttagaaaacaaaaagaggaagaccattccttctaagacctactggaatgatcgtcctcttttaactacccggtggcagtctctattttcttgtaaccagtatagcacactcggatttttttggggaatgaaaaaaacttatcgaaaaaatgaggggtagcactttcggataaaaattgaaagaaagagaaactgttccagaaaatgagctggtcctgtttctcgtcatcgcatctaatttttcctaacaaacttgatgcgatcagcagaactttctgatgctgctaaatctttctttcaattgcggatagacaacattatcaatagttaagacaaagaaagacttttctatttatttaaaaaacattccgatataataaagatatgtagggatacatctttgaaaggagtccaccatgaaaattacatttcaaccagtccgatctttagaggagattcaagaattagagcttgtcgttaaggagatttggtcagaagtctttacacctatcatcgggtctgctcaagtcagctatatgctagaaacttatcaatctccagaaacgatccaacaagaaatcaaagaaggcgccgcttattttattcttcgattagaagatgagattattggctacacagcttacgaagaagaggcagaccgtctgtatttgagtaaactttatttaacacctgctatgcgaggaaaaggcgtctccagcaaagtatttgattgggttgaatctttagccgctggcaaaacactctttttgaacgtcaataacggcaatcaacaagcgattgccgtctacgaacaccggggttttgtccgggtcggggaacgaaaggttgatatcggtcaaggttttgtaatggatgactatatctacgaaaaaacattcaaacaatgaaagacataagcttttttccatcgctcagtttgtgggaagaaagcttatttcctataaaaaaacgtttacacacctttttaactgtgttatattgtccttgtaaagattataatgttataattaggagcgctaaaatgaatggatttgtagggtttattgaacaaaagttaatgccagtggcaaataaggtaggtatgcagcgacatatggtggccatacgtaaaggaatcattgccacattaccattgacgatcgtcggttcctttttcacgatattattgaattttcctattgagtcagttgcagcatttattgaaccatatcgtgaagttctagacattccgtttcgctatactgttggtctgcttgcactttatgcgacctttggtatcgcatcttcattggcaaaaagttacaaactagactcattgacagcaggtattttggcaacaatgtcctttttgatcacggcagcaccaccaattcgggttcttgaatcggtagaaggtgtgatcgatgctggacgtttcatcaatgttgctaaccttggttctggatcactatttggtgcaattgtcacagctattttgtcagtggaaatctatcgcttctttattgtcaaaaatatcacgatcaaaatgcctgatggtgtaccccctgaagtgaccaattccttcatggcattgattcccgggggagcgattcttgttttgttttgggtcattcgtcatatcatcggttttgatatcaatggcttcttaagtaaccttttgatgccgctgaaagatgttttagcaggaaacagtttgtttggcggcttattgacagttttcttgatttgtttcttctgggttcttggaattcatggaccagcaatcatgggtccggtgatccgtcctttctgggatatctcgattgcagaaaatatggaagtttttcaatcaaccggcaatgcgcatgaattaccaaacatctttacagaacaatttctgcaatggtttgtttggattggtggggcaggaacgacgcttgcgctggttgtcttgtttttattctcaaaatcaaactatttgaaacaattaggacgtctttcgattttgccaggtattttcaatatcaatgaaccggtcatctttggggctccgattgtgatgaatccgattcttgggattccgtttcttgtagcacctttgattacaacgacaatttcgtactttgctacgacgacagggatcgttccaatgatggctgcccgtctaggatttgccattccagcacccattgctgcttggatgagtacaaattggagtgttgccgctggaatcttagttgtggtgaactttttgattacattggcgatctattacccattctttaaagtctttgaaaaacagcaattagaacgtgaagaaggacaagcgactcaagaatgaagggtctctttatcaagaagtcaaacgagacgatgggataggagcaaagaacgatccataaatgacaaccaaatgagctctctgggaaataccgagttcttctaggtgaacagaaacaattctacgggatcatcccagtaaacacctcaatcccagagtgctttctagatggttcttttgagtgaagcaattagggttcatttgttgcttaaacagtggtgcatgcgcgaggatccgcgtttgatgatcgaaaggagactaagtgcataaaatgatgctgatgtatgcatgtttattatttatcggattacaaatttggctaaccagacatggagcatttatccagcagattcgcttccgcacactgatagccgaatccttattagtattagtcattgccgttatgctatttggcaggacaacaattgccctggtgatcttgacaacactgactgttggttgcagtacgttgctgatcacaaaattttctcaaattggtgcgcagaaggagtggacaaaatgaaaagacaactaggaatctctatttatccagaccacagcagtaatgacgaagacaaagcttatttagaattggctcaacgctatggatttagtcgaatttttatgagcatgttagaagtgacagaagggaaagaaattgttcgcaagaaattcacagaattattaagatttgccaaatcacttggctacgaaacgattttggatgttgcaccggcaatttttgaagagctggaaatttcttatgatgatttgacgtttttccacgaattgggtgcggatggcatccgcttggatttaggttttgacggcagcaaagaagcaatgctgacttataatccgtttggattggcgatcgagctaaatatgagcaacgacatcgcttatttagacaatattttgacgtatcaagcaaacttgcctttcttatatggctgtcacaatttttatcctcaggaaggcaccgcattaccgtatgagttcttcgaaaaatgcagccagcgttttaaagccaaaggaattcgaactgccgcttttatcacttcacagtctggaacgatcggtccatgggatatcaatgacggattaccgacattagaaatgcatcggcatttacttgtagagatcgcagcaaaacatctttttgcaacaggattgatcgatgatgtaatcattgggaatgcctatgcctcagaagcagaacttgcagcacttggcgcaatcaatcgttaccaaacagaattttcggtgacttttacaccggagagcacttcatgcgaacgaaagatcgttctgaaagagcagcattaccgtcgaggggacattactgatcggatgattcgatcaacagaagtccgaaaaaaatacaagcaatttgataacccagcccacgataatctggaggaattccaacctggagatattgtgatcggcaacgatgattttggcaagtacaaaaacgaattacaggtggtgttgacccctcattgcgatccgcgaaaaaataaagttggatcaattgtcgaagaagaacggctgttgttgtcgtatattcatccgtggaccaaatttaaatttaccgagaggaatgattaacatgttggatatgattatccgccaggcacgtacactcaatgaagagattttcgatatcgggatcaagcaagggaaaatttgccagatcgcaaaaacgatcgaagaatccgcacaaaaggagtggacacttcttccgaatcagtatctttcggcaggctggattgatgatcatgtccattgttttgaagaaatgagcttgtactatgattatcccgatcagatcggtgtggcaaaaggtgtaacgacagtaatcgatgcggggactactggcgccgaaaatagccatcgtttctacgaatttgcacaagcagccaaaacgaatgtctttgcgcttatcaatatttcaaaatggggcatcgtcgaacaagatgaattagccgatctttctaagatcaagggggatctgatcacaaaggccctaaatgaatttcctgacttcatcgtggggttaaaagcgagaatgagcaggacagtgattggcgaaaatggcatcactccattgaaattagccaaaaatatccaaaaagaacacccaggcctaccattgatggttcatattggttcagcaccaccagatttagctgacattttgtcttgtttagagaaaggtgacgttctgacccactgtttcaatggcaaggaaaatggtattttagatcgtcagtcaaataccatcaaatcgtttgtttttgatgcttatggcaaaggtgttgcttttgatattggtcatggtacagatagtttcaatttttcggtggcagaaaaagcctatgccgccaatttgaaagctgcttctatcagcaccgatatttatatacgtaaccgtatgaagggtccggtatatgatttggctactactatggagaaattagccgttgtcggttatagttggcaagaaatcatcgagaaagtaacattggcaccagctcgtcagtttcaactaaaaggaaaaggtgcgatcgaagaagaaatggatgctgatttcacgatctttgaattcaaagaagcagccaaagtactgattgattcaaatgggaacaagcgaagtattgatcgacagatcattccgctaaagactataattggaggacaagtatatgacattgaacctgactaaacttggcttgaagcaagtcatcaatgcttctggtaaaatgacgattctcggtgtttctaaagtgagcgaaggtgtcttaacagcccaacgctttggtggggaacacttttttgagatgagcgagttagcagtcaaaacaggggcctatttggccaaactacttcaagttgaagatgctcaaatcgtctcttcagcttctgctggaattgctcaatctgtggcagcagtcattggacaaggctcatcattccatctttaccatccttattcagaaaagattcagcgtcgagagatcatcttgccgaagggacacaatgtggattatggcacacctgttgaagtgatggttcaacaaggtggaggccaagttgttgaggcaggctatgccaatatgtgctctgttgaccatattgctcagatgatcagtccccagacagctgcgattctctatatcaaaagtcatcatacagtacaaaaaagtatgctttcagtaaaggaaacagctcaagtcgcaaaacagtcgggcatccctttgatcgtggatgcggcagcggaagaggatcttttcaggtacatccaggagggtgccgatttagtgatctactccggagccaaggctttgtctgggccaagtgctggtttagtgatcggtcgtaaagaactaatagaatgggtgagactgcaatccaaaggcatcgggcgttccatgaagatcggtaaagaaaatatgatggggcttacacaagcagtagaagagtatctggctgaaggaagcgagtctggcgcttccatgaagcatcgtttggaacccttcatctcagcgctcaatcaaattattggcttgtctgcagatatcgtccaagatggtgcagggcgagacatttatcgcgcccgggttcgggtccaaaatgggccatcggcgatggaagtgatccagaaattaaaagtagaagaaccagccatctacacgagagaatatcaagcaaatcacggcattattgaatttgatattcgggcagtcacagaaactgaaatgcatgtgattgtcaatcgattaaaagaaatcatgaatccggaggaaccaaaagaatgaaaaaatccccgacttatttagaagatcgaatttgtttaaacgttttagctaactcagtggaaaacgccaaagaatgttttgaagcagccgaagggaaaatcttattaggcgttctttccaaaaattattccacggatgaagcagcgattgaagacatgaaaaaataccaagcagaaatagaaaatgcattatcagttggtctcggtgccggtgatccgaatcagagcgagatggtctctcgaatttctgctgtgttgcagccgcaacatgtcaatcaagtattcacgggagctgcaacatctcgggcgttgttaggacaagaagaaactattgttaatgcattagtttctccgacaggcaaagtcggctttgtcaatattgccactggcccgttaagttcacaggaagaacccactgaggttcctcttgaaacggcgattgcattactcaaggatatgggcgctagttcaatcaaatatttccctatgaaaggattggcgcacaaagaagaatatcaagcggtagcaaaagcttgtgcagctcatgacttttatcttgaaccgaccggtgggattgatttggataactttgcagaaatcttgcagattgctgtggatgcaggagtcaagaaaatcattcctcacgtgtatagctcgatcattgattcagagacgggcgatacccgtccggaagatgtgagacgattactgaagatgatgaaagattcattgaagtaagagtgaaggaggaattgtgatgcgaatcggtgcatacggtgaagtcatgctgcgcttgacaccgcctgaatatcggacattagaacaaacccattcgctgcggatggattttacaggaacgggcgtaaatattttaggaaatctggcgcacttcaatctttcagcatccctattgacgaaagtaccaaaaaaccgtttgggtgatgcggccaaagcgaatttgcgaacttatggtatcaagacagaatatattggtcaggcacacaatcatatcggcagttattttgctgaagttggttttggcgctcgccccacctatgtgacgtatcagaaccgccgcggtagttcatttggggtttccggacctgcaacttatcccatcgctgaatatttagaaacgatcgatcttttacatatttgtggtatttcgttgagcttgaccgaagaaacgtggcaaaccgcgataacattggcaaaacaagctactttgaagaacatcaaagtttgtttcgattttaattttcgtcccagtctgaatttggaagaaggacagcgagaaatcttaaaaaaacgttacgaagcgattctgccttattgtgatttggtatttgggtctgtacgagatttgcacggtcttttgggatttggtgagcagctgcctattgatggactagaggaacagcaaatcgttcaggcctttatggcgcagtacgggattgaatggtttacaggaaccagacggatagccagtgaagacaaacagtttatcagcgggatgatctacactaaagaagaaactgttgaaactgcacctcaattgttacaagtgctagatcgaatcggtgcaggggatgcatatgcagcaggtattcttttaggatatgccgagaaatggccactaaaaaaaaccgcggattttgctatcaccaatgctgtattggcccatacgatgttaggagatgttcccttgattacacgggaacaagtagagcaagtgctaaagaatcctggggtagatttatttcgttgagtattattcgctaggatatacaaagcacgcgtaaacaataataaatcatccaacaaagtgcgtttgatggcgaatcagtgactgccgtcaaaagggctctttgttggatgatttttgttttattcgacaggtaagaagacgaacaacaagtgaatggattgtcgagggggatatcaagcagtcgttttcattgattattgattcaggtagcgttcggctttcttctcaggaatcacccaaagaagtagaacgagactatcgagactgatcacaaaaagcggatgaatcaaccagccaaggagcaatgccacaatgttgacaaaaagagtaaaggttaatttctgatagcgttgaaatagtttcctaatggttggattattttggctttcccggcttaatgctcgtcctaacaaataatagctaaaatcagtcaagaaaatcacagcaccatagagcatttgaggagcgagggacagcgggtattgactgacccatgaagtaacaaaaggaaaaagcgacaacgagagtatcagcaaatgattggcccataatgtccatccatcaatatcttctgcaacttaaaagagatgatgatgattgttccaataaatggccagcatcacaaaactgatcaaataaatgataaactgatgttcaatgcctagaaacgcttgaaaggtatcgttttttggttggtgaagttctaagaccagcaaagtcatcacgatagcaatcactgcatctgtaaaggcctcgattcggttctttgacataacatgctcctttcagaatagtaaatcagtgttagtttacgtcaatagatacgattcgtctatcaaagagaattgcaataaaaaaaggacagtgatataagatcaaagctaactcaaaaggcaacggtgagtatgcctttgtgtctgaaacttctcattgcgagaagcattagcagtatcttatttcatcgtcctaatggattattgtttgacagtgaatgtcaaatcaaattgagaagggtggatgtaacgaaattttggtccttggctatcgtcgatgatcaattcgatcaattcgctgttgatttttttgacctcagtgatttgatgcccttggtcgtcacaaagttcaatcaccgcttctggataagttgatttgagctgattgtattttgtgataaaggcgttgacgatagcagcagacgcagtcaagtcagtatattctggcatattcttcctccttatttagtaatcaagaatgagtggatacgtttgtctagttagactctttatctaaaacaccatataaaaataaatcaatggcctgatagagttcagtttctttctctgctgaatctaagtatgaagcaatgagaataaacatttggctgacaataaactggtaggaaagttcgtttcgtaatcgtagttcacttgtttgaaaaaggcgaataaatggttgctgatagttttctttccaaatcaagtagagttttctggcggtttcttcagagacggtatgtttgatatcatccatcattaagtagaaattgaaagggtgacgtttttgcagaaatcgagccatccgttgcagtttctctgctaaggagtcattgggatcattaacgatctgatataagttttcagatacatctatcgctaaccgcgcaagaacaccgtaataaatatcttcttttcttttgaaatgataatacaaattaggctgagtaatgcctaacaactccgcgatttgtcttgttgaagttcctttatacccttgttgcatgaacaactgttcagccacgtctaaaatctcatcttgcattattttcactccggttggtttttatctgctgttttacagaacgtaataaaaaagcttttctttggatagagacagcattttttttgagaaaaacctggtaatttttctcacgaatgaccgtcaatagttcgcgatagatcaataaagcagccataagcgcttcctggcagtcttcatcgatctgaggcatcatggacaaggcttcatcgtacagtttttctgctagcagagcttcaaactcccaaagctggataaaggattcagtgacctttttttgtctgaggtgttgaatggtaatctcaaaccgctgcatcgtttcttttggtaaataaattcgattcatcgcaagatcttccccgatatcccggagaatattcgttcgctgcatagcttcccctagcttcttggccggttcttggatcttgcctgcctgactagataaaatcggcagcaacatcaacccgacacttccagcaacaaagtagctgtagctactcaaatcagcctccgtttcaggtggctgaaaatttagatccatcctctgtcctgcgagcatatcataaaatggctggaactttaaatcatatttcgcaaagacaacagaaagagcccgccataaaggggtatccagaacctttccgcaagccatttgtcgtaatccgtgttctagttcatttaatttaacgatgtcttgataacgatcgatggcatcatctgcttgccgacaaaaggcatagacggcaaacacggaacgtgctttttctgggggtaattgcgaaaaagcactgtagaaacttttcgaatgttttttgatgatttgctcgcaataagcaaagtcttccttatatcgttcaaaaagcgtgctttccttattgatcatcttttagtaactcctctacggcaagctttgcactttgcatcacgattgggacaccggctcctgggtgagtgctgctgccacaaaaatacaaaccttctgcgtaagaaaacttattatgaggacgatagtaattgctttgagataatgtcggtttcaatccgaaagtcgccccgttataagcgttgtagtggtctttgaaatcttgtggtgtatagtaggtttcaaaaacgatatgctcatcgatatcattgaaaatcgttttttcttttagcgtgtggataattttgttgcggtaattcgtgattgtattaggttgccaatcattaaacttggacagctcgggaactggcaccaacacatacaagccttcgtgaccctcgggtgctagtgaggcatctttcaatgtgggacgatagagataaaaggaaggatcttctggcaaaacaccaaactcaaaaaggtcatcgacattttttttgaagtcttcggcaaagtagatgctatgcaagccattggcttcatattttttatccagccctaggtacaagagaaaacacgaacaagaataggccattcggctgatttttttattggtgtatttgccccgatttttttcattaggaatcaattcttgcatcgcataaggaaaatcagccgcacagacaatcgcatctgctgaatggatgtgcccatttagacgaatccctgttgctcgcttgttttcaatgatcaattcttcgatcggtgagtcataatgaatcacgccgcctaattcttcaaataagcgagccagcgaagtcgctaatgtatacataccgcctttgatgaaatagacgccatagaacaactcgatcatagggatgatcgtataaagagagggcccttgatagggagaaaccccgatatacaatgtttgaaaggctagcgacttgcgcaagcggtcatctttaacaaactttgagatcgaagtgtaggcatcgttgaatgttttcaatttcattcctgcccaaagggattaaggattataaaaatcccagaatcctcgaaacgatttagtgatgaaagctttttttgcaatcacgtagcgtttataaatatctgccagaaaggcgaaataaccttgggcatcttcttcagaaatcccttctaatgttttagtgagttcaatcagatcattggaaaaggtgagaggtgcttcatcagcaaagtagagctgcagcataggatcaaccttttccatcgggatatagtcatctggatcgacaccgcatagttcaaaaatctcgcgataaatctccggcatcataacaatggtcgggccgacatcaaatgtaaaaccagcttgcttgatttggttcattttgccaccgggctggctttctttttcgtatagtgtgaccgcataacctgcttgttgcaatctgacagcggcggatagtcctgcgacaccgccgccgacaacgataatttttttcatgagaactccttatcaaatatttcttggcttcagattaatcgtgttgtgtttttgtgtgttctttttcctttaagacaccgtcttccattacaagcacccgatcacaataatcagttagtcgggtatcatgggtcaccataatcgtcgctttatttttttcctttgtttcttgcgcaagaattttgactacttcataggctttttcggaatccagactggctgttggttcatccgccaaaataattgttgggtcatgatacaaagctctagcgatcgccacccgttgacgttcaccaccggagagatcttcggggtatttgttttgcaatttatcgattcctaattgggtaaataaatcttgggcagattgggttttattctctttgctgactttgtcgactagtttcagttgctttttaacggtcaagaatgggacaagattggaagcttgaagaataaaaccgatctctttgaatcgtaatttggcccgaattttttctttctggtcactaaaaggctgatcgttgatcaaaacttcaccagctgtaggtgcttgtaatcctcccgcaatagttaaaaaagtacttttacctgaaccagagggtccaatgatggcgacaaattctcctttttcaacggaaaagtttgtctctttcaaagcctcaatcatcgtatctccatctttgaaggttttcttcacatctttaaattcaatggcactcatttttatcctcctatccaatagctttcaatgggtcaatcttaacaatcgttcttactgagaagaaagcaccgacaatcgcaatcaaaatcatcaacacactaatacctgcaaaaaagaggctgtttacttgaaagggcacagcttgcggcaagaccaacgccgttccgatcgtcgccgctaatcctaccaatacgcccaccgttgctaaaaggaaagtttgtgcgatgacagaaaatgcgatgtaacgactagaaattccttgtgccttcatgacaccaaaaatatcagatttctgcatagtcaagacataaataaagatcccgataacgatggcagcaatgacgatcaagaagccgatcataaacccaaaggttagcacttgagcactataaccaggcaattcattgatgaaatcactaattttggttgctgttaattcatccggtacttcttcaactgttcctcgcgtaacgatggcattgatgcgggctttatcgctggtatcttttgtttcaaagcgaatttcttgataggcaccaatcgtcgtgtagagaacaggtgcgacattgaagcgagcattttctgtaaagccgacgatcttcagtttcttttcattgccggctaatttgacggtatcgccgatcttaatgtcgtattcctctttcaaactgctgtcagcaactgcctcatcgtcgttcgcgaaaagttcgccttccgtgagtttaggagccaagaattgatctggttcgatcccaaaaaagctgacatcaactttttcaccaccggattccctggtgatcacacccgcagtttgagccaatacagctttctcatctgctttgacttcatcatagagattacgagggatcatggacatattcaaattgttattcgcttcctcggctaataaaatctctgatgccgaccatttatcgacagcagttcggttttcttgggcaagaccataggctagcccggtcaagaaaaaaactaagtaagcgatcaaaaacatgacaccggtaaccagtgcataccgcaatttagaatggcggatttcatttattgctaaaaacatacaacttcctcctagaaattttatcatgtgataaaatcaagttaccacattcttattcagctgcaaaatttattgctttggcatggattcttccttcctgcaaagatctgacagaaaagctgaaaaaaagcctaggaaaagcgatagaacaaaaatcctgatacctggcaatccatagaggaaccaggaaaaaacttgcaagagtgaacaatgcttcgtctcctaatcacaattaagcgtttcgtttgagtaggaacaatcaatcctgatagactaatagtggatatttttatggaaagaggagatagaaatgaaacagtatgtgcgttttggtgtgatgattttagtatcgacggtcgtgatgtttgggatgatgtacctgaatgtttttcaatgggatcatatcttttatagtcagactcgattatttatggcgttgatgatgggggccgtgatggcgatgatcatgctcttatttatgtggaaaatgtacgaaaataagaaatggaatctagcgattttagctgtcagtgtactcgtattctgtggttcacttttcatggtgcgctcccaaacggctgttgatgatgtgaaatggatgaaagcaatgattcctcatcattcgattgccattttaaccagtaccaatgcggccatcaaagatcctgaggtcaaagaactagcggatgatattatccaaactcaaaaagaagaaattgaaaagatgaaagaaatgatcgaacgactagaaaaatgaaacaaagccggatcttgacgtcttagctcaagaagtcggctttttcattcgttgttcatagcaatcagaaaaagcgctgttaaatttgatcggatctgtgagcatttcatggatctctgctaagcctgcgatattttttgaatagccgagccaaaaggtcaagtgatggtggggaccgtatttttgctgaatgtattcaaatgcctcttggcaaagattatcaggatcagaaagactctttttttcgatggcaaagtaaatcgtgcgttcgagaatccgataaaaatcaagatcacgatcagcttctgaaatgattttgccatagatggatcgtggctcataggagagggaagcacgatgatcttcgacggcttctccgattattttacgctgttctttggtaaagtaatccgccaaaaaagcatctgattctaccatagatcttgaagcgcgttcatgattttttcgtccttttaatagaccaagatcatgaaagacagcaacagtagaggcaatgtctaagtcaaccgataatggggcagcgatttctatactgttttcgagcacttgatagacgtgctcaggggagtgacttgtgtcaaattgcttgtattgtggaatgattgttgtttctaaataatgcattagctgtgggttgaccatcaaaaacctccattggctcatttcttgtttagcagacaaaaagtcatcacaacaaaagtcaatgctttattaagaatcaaagcattgatttttgttgaatcagctactttcagtttagcaaataggacctattgataaaagagtcatcgcgatcaatttgctaggagggggtaagtgagagaacaccatctaacttttggacgatttcgtctcgaaggtggtgggtaataaacaggacggtttgcggttgttgcaacagtaatttctcgatctttttagcattttcttgatcaagattagaggttccttcatcaactaacaaaataggttttttccataggaagcctctagctagtgcaagacgctgcaattgtccccctgaaagattaccacctgtttcggtaagaactgtgtctaactgctcaggtagttgttcaataactgcaaagagttccgctttttttagcgcttgctcgatttcttcatcgggaaaaaattgtcctaatgtcagattctcgcgaatcgatgcttgatagacaaagggacgttgatcaataactgtcacattgtcttgcaattcttctaaagggaattcttttatttccgtttctcccaagcggatcgatccgctatagtctttgcgccgtccagtcaacaaactgaataatgttgacttgcctgagccgctttcccccacgatggcatacttttgtccagctttaaaagtggttgagagattgaacaacattcgttgcggttttccatcggtcgtttgataacaataagaagcttgtgccaacacaagatcttttgcatcgtttgtttttttgctgggtagcgaaatctcatgcgctggcttctcataagcaaatgcatcgaataaagggaatgtgccttgtatttttgacagataggaactgatatttcctaatgtattaaaaattgtcgaagcaagatttcctgttgctgtaatcgctccgatgggaacgatttgcagaaaagccaagtagccagtaaaacctaagacactcaattgaccagtcacattgccaattccgccagttacagagacagcagccatcacttgtgcttgttttagctttgcagactggattctttgtgcggaacccaagagtttatttttaagaaaatcaagacgctggaaatttaggaaagtatcaaatccagctaacagttcgttggttttactcaaaaaagcttcatttgcctgggcggtagcgacagctgattgtttcatctttttttggaagattttcggcaacaaaagcaacaaacaggactgacctaaggtgagcacgatcaatgaccaatgaaattgggctaatgcgataacggcaaatagtgaagacaatacaccttgcatgacctgatagatattggcgaagccatctgtttcgatcatggttatatcgttactcaattttgatgcatagttgcctacggtaactttgtggaatgtctgataatcactgtatcgtagccgagtcaataattgatctcgcaaataaagggacatcttctgagatgtataggctgtataacggatttgcagataaataaacatcaggaaacaactataggctaagaccatccctacaacaccttggataaatcctttttgatcgaattggatgagactgtttagaacctgcacattttgcaagctggctatcgtttgtgaaagtgcgactcctgccattaaaagcaggacgactccctgatttttccaatgtaccaataacacctttttcattattttttgctcctttcttattacctttcttgatacctttattgtaaaagggtaaagtaaaagcgaaggaataattacatatatgtaaagaggtgctgtgaatggactatggagcgacatttaagaaactacgtttagaaaaagggattactttgaaggaagcatgtcagcaagggatatcaagtgcacaactttcacgttttgaaaatggaaaatcaatgttgacggtcgatcagttttttacatgcttgcaaaatatcaatgtgacgatcgaggagtttcaatttgttgggaaacagacttttaaagaccgttttgaaaagtctatcgagcagatgcaggagtatcttaatacgaatcaagaagagtcggctcgttcgttggcacaacgtttttttgctgaaagtcagagtccgtatgattggccgcagtttttaggctgtttcattgaagatgtactcaatgcaggaaataatcgtccattcattcattctcaaaaagtactcagctatctccagcaagtcaataattggggtgagatggagttgcgtttgatcagtatttttacctttgcattggacacagaacagatggatctattactgaaaagcattttgaaaaaagccaagctgtaccaaagtgttccgcaaaccaatgccctttattatgatctgttggagaactttttttctaaatatgtgtttcaccgcaatcttccagcagccagaaagatccagaaactgtatcggcagagtctggacgaacgcacaattttattgcgccccagaatcacctatatttttaaccaaggaattcttttttatctggaaaaacaaccagaacagggcaatggatgctttgaccaagcaatttctttagcgagaattttttatcagaaggaaaccgaacactattttgagaagcgggccaagaattggcgggaaaattatcaagatacgaattatcgtgagctgacgatcaatctgaatttttttaattattaaaaaggggttgacttggagttcactcgaaggcgtatgctagaagtatcaatcttaaggaggaacgacaatggattatgtaaaatttggacatactggattagaagtctcccccctttgtttaggggcaatgggctttggtgatccgaaaagcggctttcatgaatgggtattggaagaaacggaaagtcgagaagtcatcaaaaaagcccttgatctaggaatcaatttttttgacacagcgaatatctattcctatggtgccagcgaagaaatattgggaaaagcgttgaatgattttgccccacgagatgaaatcgtcgtcgcaaccaagctctattctaaaatgaaaaaagcccccaatagcggtgggctttcacgcaaagcgatcttttttgaaattgaacaaagtttagaacgattacaaatggactatgtagacctctacattattcatcgctgggattatacaacaccgatcgaagaaacgatggaagcacttcacgatttagtgaaaacagggaaagttcgctatattggtgcctcagcaatgtacgcttggcaatttgccaaagcacaggcggttgcagataaacatggctggaccaaatttgtttccatgcaaaatcatttgaatttattgtatcgagaagaagagcgggaaatgctccccctttgtgatgatcaaaaaattgcgatcacaccctacagtccattagctgccggtcgtttgactcgtgattgggatgcacaaacgaaacgttttgcgacagataaaacagcacaatcaaaatatgatcagactaaagaacaagatcaattgatcgttcgccgtgtggcagagattgctgagacacgtcaagtcaaacgagcacaagtggccttggcatggctattgcaaaaagaatcagtcgtggcaccaatcattggggcgacaaaagaaagtcatttactggatgctttgccagccattgagttgaagctatccacagaagaagttgcttacttagaagaaccttatcttccgcatgcggttgtaggcgccaattgattttactagagaaatatcgtaggaatagcaggaggaatctatgtgaatatcaaaaaaataagtgaacttagcggtctttctgcagatacgatccgctactatgaaaagattgcccttctaccaccagtcaaacgcaatgctcatggtgttcgagtctttgatgaagaagatctcaagtggatcgagtttaccagtaagatgagaaaagcaggactttcgattgagtctttgtcaacctatttggcgttatttcgtgaagggagtcagacagttcctcaaagaaaacaattgctagcagagcaaatcgcagcgttgcatgaacgaattgcaaccatgacagaagcggtagaacgattggaatacaaattggaacattatgatgaccacatcattcctgctgaagctcggttacgcaaagaaacgtttacgaattaattttgcaattacacgtaatcccttttaggatacagccgaaataggaaagaaatcgtatgacaaaagtaatgattttcggtacccaagatcttcttctgttatcagaaaacaattattagcgagagacgagacgcttgttttgtacgtgccaaaaaagaatcagacgacattgcttgatcctcaacgagaaagcatgtttcaaggtgatttactagatctaggcaggatcttgcgaggaatgattagttgtgaaatcgtttacctttgtgagatgcctgagccacaagtcacctggcgaatcatagaagcgatgaaactacttgacttaacccgaatcatttgcctggtgaaaccagaggaaagcttcctgtcagatcaaatcccggaaacaaaaacgacgcacaagaaagctcgaagcagtcaaatgacattatctattcggatgattgaagaagcgatgtgtgactatacgattttgcatcttcctgctttttttgcatgagtgttcacctgaatctgatctgcaaacgagcaaggacaatcagataagagaagtcgaattacaagtagcagatctacttgcgcaaatcagtgagcagccaaccttcttggctaagagaactttgtttatttcgaatcatttgttataaaaaaatccgttgaattaaataaaggttgtcgttttagcgattaccagaagagtcaaatttttcatagcgacatgaaaaatttgactcttctttctgctgctttttttgttaaaatggcagcaatatcaagaagatcaatagattgaaatacagaaaggaaacaggtggatgactatcaaacgaataggcttgatttcattaggggtgttatggatctgtattgcattgaacttctttcttttacctcacagcattgcctcggccggggtgggctcaatcgggtatcttatagaaacaggattagccattgatcgccatctgattgtctggggaatcaacttgattatgttaggactagcgtttctttttttagagcggaaagtctttatcaataccgtcttgggaagcctgttgtttcctgtcatattagcatggattcctgaatggatggtttgggaattttacccagcctctttgattctaggaagcttcttctttagcttagggatatttaccctttactgtatcggtgcatccaatgggggagtcacgatcccaccgttgatttttgaaaaatatttcggcataaaaaaagcagtcgggatcttcttgaccaatacaacgatcattgttttgaactttctggtctttggactgagagaagcgatcatttctgcttgctcgatctatctcattgctttctttatgaatatcttgctcaaagggcagcgtcaatttgtcaaaagaaaggaagcaaaggagtccacacttgcatccgctcctgtcaaagaaaaaagaacggctggatgagggaacctctcttcgattccctttgttgataatcgcgttcgcgaagagagattgagattactgtcgggactaaaaaatatcacttattcaaaataacagcctctctgacatcaattgtcagagaggctgttatttactacttcccagaaataatcaaattagtctaaagctttcttttttgaaaaatcgaacgactaatgattaatgacaaaaacgatccgactacagctatcagaacagctggtaagaagtccatcagctctgaatttccttgaatataagcaattgtctggctggacaatgaataaggattgatcttttggagagattcaaagagactgcccaatacgccaataccataaaaagcagctaaaaagagtaagacttggtaaacatttttagcaaatgcggagcttaacagcagtaagctgattgacaatagcccaaataaccaataactaaaacccgcactgataagatgatgggtcaaagagtcattgaaataaattcttgtataaagaagacaaatgagaaaagcggcagcatagaaaagtgtccaaaggaaataaagataaagtgtttttgctaaaagaatcgtttgtcttggcaatccctttgtgattagattgatcagagttccttgctcaatttccgcacaaatcgtatccgcaaagagtatcacaaaaaccaagagacccaatgaaccgatattgccataaaattgcatccacgaatcgacagatgtcggcgtggaaacagtgatttggatcccatctgtcaccatggaagaaaagatatccggcattatttttgccagaaaaggcgagagcatgcccaccatcagaaaaatcactccacaaatgatgatctttttattccgccagccgcctaatacttcttttcttaaaaaaactgttagctgcgtcatttaactacctccaaatagattttttctagcgaggattcatttttttggaagagtaaggggaccaattcattttcagccatgagttgcagcactttttggccttgttgaaaagtttgattttctggaataatcagttgatgtttttccctcgtccaattaatcgccgcacctttcgcgagctgacagaaatgctctgtttcttgtgagctggcaaattgaagaagataatcttcttggcgaaattgtgtctttaattcttccatttcaccaaagagtttgatctttccctgatgtaaaatcgccacgtaatccgaaatttgttcaacatccgataaaatatgtgaagaaaaaagaactgtcgtttcttgtttgatggcaagtaaaagatctagaaaggctttgcgtcccagcgggtccagcgcagaagtcggctcatcacaaatcaatatttctggttttgacaataaagcttgtgcaagacccagccgttgcctcatcccccgtgagtagctgctgatttttttggtgtttttttcaagattgaccagctgaagaatctcatcgattcggctagtcagctgtttgccaagaccgcttatttttccgcaaaaattcaggtattctgttgcggtcatgaaagaatagaattggggaacatccggtaagtagcctatcttacggtttgtttgagcatttccatagacaactggctcatcgcagaccgtgatctgcccactatctgactttagcaagcctaaaatcagcttcatcgttgttgttttaccagcaccattttccccgacaaagccgacaacactccctttgggaacgacaaaagaaatggcatctagaatttttctttcgccaaaagacttagataattgattgatctcaatgacgttcattctttttctcctttcccaaaagtgaaatacaaaattggtccgataatactaatcaaacaagaaacaagtatccataacgtgcggttgccgaatttaaagtgtttctgtttaacgatatctaaaacagaaacaagtatcaacccgaattgcaaaagtgctaatgggatcagaatgggtagatagtcaccaatattttctggaatgctcgtggtcatcatcgtgtttcctcctttccatgagtgtcatctgcagtatgggcggctactgcttgcaagcgctggaataattctgtaaatgattgttgatctttgaagggctgcaataggggtgattcaagaatcagccctgtcaattgtttttttaccatattagaaatacggggcatctgatttccaagttccaactcatcaatccaactttcgatctgatcaaagtacgcatcaccatgaaggagataaggatcttctgttttttccagcaatgagacataacgagtcaaagcgcaaagcaagcgggcactattgccttgtacagcaaaagtggtcaaacaggcagccaaaaaattgagcataatgactggatgtagtctggataagtcaaatgtttcacaaaaggccagccctcgttggtaagttgcttccatagcttggggttttttggtcagcaaaagcgtgtagttagtcaacagactgagtaaaactgtgacatattgataaatggcactttgaagaacagtttctgcggctgagccatctgccatttgttggtgcgcagctgcaatcaaagattccactggcaagaaaacgggtgtcttatttcctaatacacctaaaacgtcctctgcctgaccaagcataagcattgaataggcttcataatagctagcttgttgcaggaggtcagcggaaccgttagttttgactaattcaaataatttaaccgcctcttgtaagtaatactttcgttgatcctcaacagttttctcattatttggtacttgttctgtcctagtaacttgagctggaataggcaacagatcccaatgattcagataaaaaagtcccatctgcagcagaaatggatagcaggaataataacggcgaatgaatcctctcagcataagtaacatgtcatcagcggatttagtttcaaacgagtctttcaacaactggtaaatccgcttgatttcttgagttgttagctgagaattgatcactaaaagatcatcgacgctgcaatcaaagaaagcagccaggagtggcaacaaggtaatatctggataagattggcccgtctcccatttagaaaccgaggccttagaaacactcataaaatcagctagctctgtttgagtgatttgtttgtcctttcttctcttagctatttcctgtccaattggtaattccatgacgcacctccattgaattggctagctttattgtagaacaggaaagagaggagcacaatggagaacaagttaacttttgattgataaagttaaccatgggttgataaagagtagcaacactcttttttcttgttgtaagacgtatttcagtgtttaatgaaagaaaacgaggtgagggttcgatatgaaagtgatagcaatgattgactcatttaaagggagtgctacctcggaagaattaaatcaggcagcacttaaagggtttccagtacaatgggaaaaagaatcaatccccatcgcagatggtggagaaggaacaatggctgcgttatttgctgcctatggaggacagtataaatccgtaacaagtgtcggtcccctaggagaagaacgagtagtttcgtatttactgacaacaatcaatcaaaagcgaatagcgattattgaatgtgcagcaatcatcggtatccaattacttgatccatcagatcaaacaaccagacaggctagttcctacgggctaggtcttttgatcgcagatgcaatcaatgaaaaagtagcacagatctatgtaacgttaggtggcagtgcaacaacagatggcggactgggtttactggaagcattaggtgcggaactaatgtatcaacctgcggcagatgcgcgcaatcctttgttgaccataaattatttttcgataacagcagtgcagaaattgctttctggtatcgaactgttggttttagcagatgtaactaatccttatactggagctgaaggatttgcaactactttcggacctcagaaaggtgctttacctcaaacggtacaggtattggagcagcaagcaaaaaaagtagcgtatttcgtgcagcaagaataccaaattgatttaaatgggatcgctggaacgggtgctgctggaggtatcggcggtgcgatggtcttactagggggacagatctgtccaggatttatgaccattgcgaaactgttgaaattagagactagaatcagtgatgctacgttgatcatcaccggtgaaggccgttttgaccgtcaaactgcagccggaaaagtgccattaggtgtggccaaaatcgcacagccccatgctattccagttgttgcattgtgtgggcaaagggagcctgatctaggagagatcggtcagtattttgctggtattttcagtattcaaccaggcccacttctccttgatgaagcaatgaaaaaaagtgtaacgctcgcaaatatggcagaaaccgcacaggctatcgcgatgtttcatgaaaaaatcacaagagcgaatcatggtgatggtggaggaaatggatctttctaatagagcgtttttttaatgggcatttttttcatattagactgaaataatcgaccgtttatttttaagaatcccccctatacttatagacaagcgaaagctaaaaagacattagggggaatggcaatgaagtggtatcaaatttcaaaagaacaattgatgaagcagctacagtccgatcgtcagggactttcaaataaagaacgtcaggcacggttagaagcagatggtgcaaatcgcattgcagaaaaagttcaaatcaaaacttggcaaaaaatcgcaaaacattttacggatctgttgatgatcgtgttgatggttgctgcagctttaaaggctgttacaggtgattatgtagaaagtggcatcattcttctagttgttatcatcaacggcattgtgggttactggcaggaacgaaaagcggaagaatctttggacggcttaaaacaaatgatgggccaagaagccgtagtcattgtggaaggactgcagcaaactgttgccgcagagtcgatcgttcaaggagatttagtctcattgaaggcgggcgatgtcgtaccagcggatatgcgattgatcgaaaatcatggattggtcgtagaagagtcgatcttaactggagaatctgagccagtcaagaaaacagaacacgtcatcacagaaaacagtattattggagatcaaaagaacatggtcttctctggtacacttgttcaaagtgggtcagctatcggtgtggtagtagcaactggcgacgagacagaaatcggtaagatcaatcaagctttgcagtcagtgaaatcacaagagacaccgttggtaaagaaaatgcatcagttgaacaagcagatttttcgcggtattgtcgcgctgattctcttcttaattttctttaccgcattccggtatggtctagaactaaacgtgttgttttcctcagtgatcgcgttaatcgtagcaatggttccggaaggattaccagctgttttaaccatgattttgtcaatgggtgtcaaagaaatggcagatcagcaagcaatcatcatgacgatgccgtcggtggaaacgcttggtgcaatgacagtcatttgttcggacaaaacaggaacgttgacaaaaaatgaaatgaccgttgtagatactgtcactgtaaccgaaaaagagcaagcgctcatgtacgatatcatggcaaattgtcaagatctgaaacaagatagttctcagcgggcagcagatttgcaaggtaatcctactgagcgggcgctgctgcagtttgtggagactcaggaattacccttgcaacaagttgcagcaaaaattccttttagctctacttacaagtacatggcaactttgcatcctttgcaagaggatcaatcaatcttatatgtaaaaggcgctccagaagttttgctaaataaaagtcagctatcagaagatcaagtatcctattggcagcaagcggcttctgagctagcacagaaaggacagcgggtcttagggttcgcatacaagacagttccagcatccagtcaagttgctcatgaagaagtcactgatttagtcttcataggtcttgcaggaatcattgatccgccaaaagacagtgcaatcaaagcagtgagagagtccttacaagcggggatcagagtcaaaatgatcacaggagaccacaaagaaacggcgcaagccatcggcgagcaagtcgggttgaaacatacgaagaaagttcttgaaggattagatatcgaccaaatgaccgatgaggagttggcacagcaagtcaatcacgtggatgtttttgctcggacgacgccagagcacaagctacgaattgtgaccgctctacaaaataatggtgagatcgtaggtatgaccggagacggtgtcaatgatgctcccgccttgaaaaaagcagatatcgggatcgctatggggatcaaaggaagtgaagtaagcaagcaagcagccgatatggttttggcagatgataacttccatacaatcgcgaatgcagtcaaagaagggcgacggatctttgacaatctgaaaaaaaccatcaacttctttttgccaacagcattagcgcaaggattgattgtcatttttgctctcttgttaaatcgcccattacctttgactccagttcagatcctctgggtcaatatggtaacaacaattacattgtcttatgcactaggattcgaaaaagcgagtaaagatgtgatggatcggccgccacgtccagtcaatgaaggaattctttccatgtacagcatgttccgaatcgtctatgtttctctactgatcatgattcctgcttactttttgtccatgcaatttgaagggcaagcagtccagcaaacgattctcctgcagaacatcgtattaggacaagcagtatacatgttgaattgtcgggagcttttagagccagcattgaacaagagtatgttccaaaatcgggcactgttcatttctctaggaatcttggtgatcatgcaaggaatggttctggtgttgccagttgcgcagcaactgattgggacaactacattgacgcttgtacagcatcttagtatcgcagtaaatggcttcttactctttgcggtggttgaagttgaaaagcatctaatgaagcggcgcgccaatcggcaaaatacaaaaacaaccaatgaattaagctaagtcattggttgatcagataataggtttggatgagctcagtcaattgattgagctcatttttagttggcagcattgaaagatagaagactggtaatttgggatcatccaaagggacgttcgaaataatgaagtcgtcatttcgagtagtcatccctgcgaattcagctggttcgactgggactaattcgatcctagaacccaaataatcacttatttcctgttgcaagaaaactttccatgctggttctccttgaaagaagaagaaagctcgggtcgttactggtcgtgcctgaagcacagcttgttgtacgaggagtgaagccatattcaagatatacttaggttcatcggttacaatggcaaattttggatctaagataaatttccgtaatcgttcaaaaattgcttgatagttgtgttgacgaatgtgcatcatttcttgatactctaattgaaattgttcagacagttttgcggattcattgaattttaagaccaaaagcagcaaattgtccgctaactgggtttcagaaagtaggggaatcgccaattcttgcccaagttcttgaacaaatcgctggacggattgtttgatttcctgataggcatctagtgtgacagcaattttgcttgtccactgattgttgtaattccaactttccagaaaacaatagaaactaaagaaacactcctcctgattcaaatagacgccttctttttgataaacttgctggagcgactgatgatattgtaaaaaaagcggatctaaaggatcaaaagcgagtgcattgacccgacaattggctttgattcggattgtattgatgaagaaccagcaagtgccaaaaatttcttcagaaagaacgtccaactcttgacgtttcagtgactgtaaaaagataagataatgtgattcatgaatagcataatcttcaaagaaataattattgtgggtaaaaggcagcagcagacgatggaagaaaactcgaatgctgatctcactacctgacagtttgacttgcttggcgttcaactgaattcgaatattgtatggtttaatgccacggttgatttttgtaacatgacgtttcaatgtttcaaaagagataccactgtcatgcaagaaagattgtgttgagattccttttgcaaagaataactgtttgatcaacatagcgccaattgaaagcggcaagaagctttcccataattgattggttagttgggaatcttttttaagtaaagaaaagccattacttgtcgcttcgatttcccatccgtcaggcaaatgctctcgaatatactgaatatctgtaaagacagtccgctctgtagtttgaatcgaagcagccaatgcctttgccgtaatcgttttgtgattggataactcttcgagaagcaggatctgccgtaataaatctttttctgtaatgatacttttcatcattgtatccatagaaagcttcctctccgattcagaataagctgattggtaaaaagttttcttttattttacctcgcattgattcagaatgctatttctttttcgtataagaaaaggaggggagcaggatttttgcttggatccttcaagcacagtagtattccataaggtcttgtggcatcttgaattctactgtagctcatttattaactattcttattccgaaaacgacaagttttggggttccgttgggtaatactgttcactattaaattcggttgtttgaatatcattgggaacgatttctaaacaaaaatcatcagcccacaaagtgccttttccctgcaacaaaaacccaaaatttaaaacttcagcttcctgtgagacatctaagacagaagaataataattccaatcatttgtgcctgttactggacgattctgcatattatcgaacgctaattgttcaaaattcttgccatcaattctcaaccaaattcctccccaaccttcaattgattctgattttaggtatgcgcttaatcgcacacgttgattaatgtaattttttgcactcacttgttgcataacagttgcaaaattctctgtgtataagctctctgtttggctcatttttactgactgatttccactatgaaaattcatttgatcaattgtcacttcatatttgtcaaaattatttccagaaagcaaccagccatttatttttgtctcacacattttttgattccccctaaaaaagtttttaaattggattctatattgtcgaggagggagttgataataggacttaaaaactctggaaaacgcctcttgtgaggaaaaaccgctgatcagagcaatttcgataatcttcaattcgctcttcaaaagtagtagggaagcatgggccatacgtcttttttgaagatatttatatactcccatgcccagttgttttttaaatacacgctgaaaatgaaattctgacatgccggctttttttgcaatttcttttgaggagagatcgccagtcaaattattttcaatgtagagtaatgccagttgaatgtcttttgtataatccataatcacctcactgcctccttgtatgtagaatacatcttttattggaaggttttttgataattaatgcttttttacgataggtatgaaatctagtgtaacaacgataagttttattgaaaagtacgaatagagtacttgttaacgttcattttcctagagatgattataaccaataaaagaactgagttcgagacacaatcatttcttttgaaaaaaaagtgaataggagtaaaatataagtgaaaaaaagaacattaggaggaaaaaatatgtgtacatcaattacttattcaacgcgagatcactattttggtagaaactttgattatgagctgtcttatgaagaagtagtcacgattactcctaggaactataagctgtcttttcgaaaagttggtgagttatcacagcattatgcgatgatcgggattgctgctggtatagcggattatccgctgtattatgatgctaccaatgaaaaaggtttaagcatggctgggttaaattttgctggttttgcagattacaaagaaccggttgagaataaagacaatgtcacaccatttgaattcattccctggatattagggcaatgcagcacagtagctgaagcaaaagaattgttgaataaaatcaatttggttaatatcaattttagcgaaaatcttccgctgtcgcctttacactggttattagcggataaagagtcttcaatcgttgtagaaagtatgaaagacggacttcatatctatgataatcctgttggtgtcctaacgaacaatccttcttttgactatcatttgtttaatttaaataactatcgttctttatctagtaaaacgccaaccaataccttctcagatgcaatcgaattgaatgagtatagtcgaggaatgggcggaattgggttgcctggggatttgtcctcgatgtctcgatttgtgaaggctgcattcacaaaactgaattctgtatctggtgattcagaatcagaaagtatcagccaatttttccatattttagggtctgtcgaacagcaaaaaggattatgtgatgtgggagacgggaaatatgaatataccatttattcttcttgctgcaatgtcgacaaagggatttattactatcggacctatgaaaatagtcaaatcgtcgccgtagatatgcataaagaagacctagacagtgaaaaactgattagttatccgttagttgaacaacagcaaatacacgttgctaattaatcggtaaataactttcagagaacaacggtagcgtacgtatcgcttggatgacgtgatcgaaagagaagttggtttttattgctaagaaatacgacagaagatgattgatgactagcagcaatgaccaacgtctttagataattgatttatgaatccgtgtgttacagttttttcgtgataactcggacattcgtgagatgaaaaaataaaagaacttgctagtttgataagatgcactttttggttgaacaaagagtgcatctttgatttatattgggcacaaagcaaaacaaaaaccgctaaggccaagggtccttagcggtaaaacaacgttttttgaatacgggttcacctaagtaatttcaattaaggaagttcatgagttttatccttctggataattgattcgtatattcgtgcaattcgttgggctagcaaccaaatcaaagaaaatggggttattggtttcattactaataattcatttatagatggaaatgccatggatggaatgcgtaaatctttgatagacgaattttctgctatttatattttgaacctaaaaggagccattagagggaaaactaaagaacaatcaaaaattgaaggaggaaatatttttgatatcatgacgggagtaacaatagttattttggttaaagatacatcgaaaaaacaacaaggaattttacattatttagatattggtgatgggttaacaaaaaatgagaagttatcaaaactagaagtaaatccgtacttttcacgtattttatcgatgattttatccagtttaatctgctttatctgctcctcagcatcagcaaataaatcaagctgaatacttgatgtgtaaattaactttgaataggtgatacctacatgacggacgacttgaccagtataatatttacgaaataaaaaaaggcaatgttcaactagcttctttgtgttatcagtaggtgggaccgtcatctgtcgtgagaaccctttttgtgtttctccaaaagcaacaccaatgtaaatggaaacacaagaagtttggcagtgatgtctacgaatacgtgcagcaacctgttcagccatctctttaacaacaatctcgatttcatcttggagataataatttctgtttagtacttggctattaccataactcttgtctctcgtctgaggagctggctcagagattattgttcgatcaattccattagcgtgatgatataactgctcaccaataattcccattcgacttcgcaacaaatcaggattagccttcgcaagttgctcaatcgtttctatacccattcgctcaagtcgtttttgtgtgcgtgatccaatgccccaaaattctgtgataggagagatgttccaaaccttgctttccacgtcttgataggtccattccgcaataagtgatttattatgcttcgattcgttgtctaatgctagtttggccaaaagaggattgtctccaatcccaaccgtcacgtatagctttgtcgtgtcatagacatcacgttgaatcatcttagctagtcgccatcgtctttcgcttcgagacaagcttttgtctggcacaaacaagttcagcgatttagttacgtccatcattgattcatcaatagagtagaggagtagatcctcatcggctacatattttctaaatacattgtttactttcagattttcttttatatataagttcatgcgtggagggaccttgaataggagcggatggttcggtaaattatcagcacgagtaacgtttgagattcccaatttcttttttgccaatggagaagcagcaagaaccagtccgtttcctgtattatcagattgggacatgacaaccaacatggtcttcattgggtgaaatccacgttgaacacattcaactgaagcataaaatgattttacatcaataaaaagaatgtcacgtttgggctcaagttcgtatcgaaaacttcccataatagctcactccttacggaaagtatacgaacttacgttcgttttgtaaagcgaacagaaaataaaaaaagctctctaccaaataaggtaggagcaattttaatgattttattcatatcaaacaaccttagtataagttctgccactcatcgattatttagttaaatcgaatgtaacatcaaaatctttataattatcctcgtcataattttcggtgtcgtagctagcagaccatttcaatcgaatattagaaacgttgctaacatcttctattttaggtactgaaaatgtcacaattccttcttttgttacaccgcttaagatttctccaccaatactatcacttaaaaacatctcagcttcgatttgctgaccttccacaaccattgttgcttggtctggataagtatcaaaatccatgtccgaattgttggtaatttcgaaatatacttgaacagcgtatttattttctagaccttgcatttcaatctcatcatcggatagttctacaatcactactttattgatgttcgtggtcaggccattccaatcttctgaaaaattcgctgaatattcggcacggtccacggtggcactattgctttctacggtgctactttcagtagtattttcagcagaagattcaacaattgattcggtttgagcagtggcagaaccttgagtaactgttttcttatcttcgggacttgagcaagccgataagaataataaattgataccaataaaaacacccaaataaacttttttcatgttcgttataaactcctcttcttttttcttaattgtatcagaaaaagaggtaaagaatctataacttatttggcgcttatatatataattcaactttctagttagcctaatttcaaaaaaactaaatcaatttggcacacatttggcacaagaacaaacaaaaaccgccaagaacaagggttctcgacggttaaataacgtcacaggagggattcgaacccccgaccgtccgcttagaaggcggatgctctatccagctgagctactatgacaagtcagcaacaaataacattatagaaaaaggagcgcctaatgtcaatcgcttttcgctatttttgccaactttctttaaaatgactcgttactcgctggttgtagccacgtccacatgatctgcttctttcgtaataaggataacgccatctcctaagggaattaagctagaagtcagttggggatgatccatcactgtattgaggaaaaggtttagtttacggtggatggcccgttgtcctcgtggaatgtcttctataggatctaaaatcgttcctgcctgaaagacgtcatcgaccattaacacgccgcctttacgtaaaagtcgtaagcattccggtaaaaattcgatgtatttagactttgcactatccatgaaaataaaatcgtaagggccatcaagtgtcggcaaaacgtctgctgcctgtccctctaaaagagtgactttatcctcaaggcccaattgtttgtaagtttctctggcttttttgatcatgacatcatagcgatcgatggtagttacgtgaccatcacctacatactgtgccatcaaacttgaagaaaagccgattgctgtaccgatttctaatatttgcttgggcttcatttgtcctaataaaaattgcaggaacaccactgtctcatgcggaataataggaacttctttttcatgagctgcctgttcgatttgacctaatttcccagttaattgcttttgtttttcccgcataaacgccactagttctttttttactactggacgatgcatcatttcgttacgcatcctgatcctcctaaataatttctgttacttattatacggataactctctttgagttcaatcctttctacttgggaaaagaacagatcttttgctcagtaagacaaaaaaaccagtcgaatgactggtaggggagaaaggttgaaaaataatttttggtatacaatgatactaacagagcaatgtttaaattgtgttaagagtctgtgaagatataaccagtattcgctgaaaaaaatctgttttaaaggaacgtatttcaaaataatttcttacttctaagagatatgaagagagaaaaggacacttttatttctttttctctaatattatctatctaaatattcagaaaattcaattaaaagcattgacagatgcagtgtctttcggtatcttcttatataaggtaacgagaagcagaaagtgacaggtgaataaaatgaatagaaataggccgatgaacactagcaacttattattaccgtgaggactcttttttgtatttcatgatctgatgacgtgaaacagaagagtcctattcgcattgcataaagggaagacctttatggagtgctttttttataccctaaaagaacaaatgagccagaggaggaatcagtttgagacagatccagttttttgacaccacccttcgagatggagaacagactccaggagtgaatttcaatacgaaagaaaaggtacagcttgctttacagctggaaaaatggggaattgatacaattgaggcaggttttccaattgcttcggaaggagactttgcagcggttcaagcaatcgcaactgctgtatccacgatgacagtggcaggtctggcacgctgtcaaattaaagatattgatcgcgcttatgaggcattaaagcaagcagtaagtccccagatccatgtgtttttggcaaccagtgaagtccatcgccgttataaattagccatgactaaagaagaagtaatccgagcaatcaaagaacatgttacctatgctagaaccttatttgacaaggttcaattttctccagaagatgcgacccgcacagaaaaagattttctgttagaagcggttcaaacagcgatcgatgccggggcgaccatcatcaatattccagataccgttggctatagtaatcccactgcctatggcgaattatttgcctatttgattgccaataccaaaagcaaggaaccgattatgttttcctcccactgtcacgatgatctgggaatggcaacggcgaatgctctggcagctattgagaacggagccactcgtgtggaaggaacgatcaatggcattggtgaacgggccggaaacacggcgttggaagaggtggcattagcattgcatgtgcgtcaagatttctatgactgcacaacgaatatccagttaggcgaaaccaaacgaaccagtgacctagtcgctcgactatcagggatcgctgttcctaagaataaagcgatcgttggaggaaacgcctatgcacatgaatcgggcatccatcaagacggcgtcttgaagaatcctgagacatacgagatcattacgccgcaattagtcggtgttcaaacaaattcgctaccgctgggaaaattatctggtcggcatgcgtttatagaaaagatgaatcaattaggctatcagtttgactctgaggaaacaaatgcattgttcaaacgattcaaagaactggcagacaaaaagaaacaagtaacggagcaggatttgctggcgttagcagcggatcaaggtcgcacgcaaacagagggcgttgaattagaggctgttcagctacaatatgtctccaatggtcatcaaggtgccgtggtatcgatcacaaaagatcatcaatcttatgttgcctcagcaattggcgctgggagcattcaagcaatctataattcgatcgaccagatttttgatcagcaaccgcgactgctaaattatgaaatcacggctcttacgagtggagaagatgcgcaagcagaagttcatgtagctatcgaatgcgcagagacaaaccgacaaatcagtgggatcggtgttgattttgatgtgttgcaagcttctgcaaaagcctatgtacaagccagcgctgctttgaagaatcgaggcgagaataaatgaagaaaatcgtcgttcttgctggtgatggcatcggaccggagatcatgaccagtgcattgcaaattgtaaaggcgtgtttgccaagcaacccgtatttctcttttgagtcttatgcatttggcggacaagccattgagcagtatggcacaccactgccaaaaaaaacattgcaagcttgtcagcaagcggatgccattttgctcggagccattggggatcccaagtgggaaaatgcagcttatacactggaaaaaggtttattggacttgcggcgcgcgcttgatctttatgccaacattcgccccatcaaagtaacggatgcttttttacccttttctcctttgaaagagcagatcgttaaaggaaccgatctggtactggtaagagaattgacgagcggcatttattttggagaaaaaaagctatcggcaacagaggcttcggatctgaattattaccatagggaagagattcgccgtatcttacgaaaggcgtttcagatcgcacgaactagacaacggcgagtagtgtccgtggacaaggccaatgttttggcaacaagcaaattatggcgaaaggtggcgaatgaagtagcgcaagaatttcccgattgtcagttaacacatcaatatgttgattctgccgctatgaagatcttgcaacagccaactgtattcgatgtgattgtgactgaaaatctttttggcgatattctcagcgatgaggcgtcagtcctaccaggatcattaggtgttttggctagtgcaagtcatagtctttctggggtttcactgtatgaaccgattcacggttcagcaccggatattgccggcaaagatattgctaatcccatttcaatgattctgtctgtggggatgatgctaacttcttttgggatgaaatcaattgctgatcagatggagcaggcgtgctatcaagtgatggaagatggggtcgtgacttgtgatcttggagggaatactactacaacagaatttacgaatgcggtaatcaaaaaattagggggctactgaatggggaaaacattatttgacaaactctgggaacgtcatgtagtgctggaagaaggtgaggcacagctgttatatatcgatctgcatctgatccatgaagtgacttctcctcaagcttttgaaggactgaggcaagctggccggcgtgttcgttgccctgaaaagacctttgcaacgatggaccacaatgtcccgactaaagatatttttacgatcacggatttggttgcaaagaaacagatagatacactgcgcaacaactgccaagcatttgggatacagttatgtgacaatggctcagcccgacaaggaatcgtacacatggttggcccggaaaccggtctgacacaaccggggaagacgatcgtttgtggagactcacatacagccacacatggcgcgtttggagctatcgcttttggtattggcacaagtgaggtggagcatgtttttgcaactcaaacgatttggcaaacgaaaccaaaacgtatggggattgagatcaagggaactttgcaaccaggcgtctacgctaaagatatcattcttgccctgatcgccactcacggtacggattttggagtaggtcatgccattgaattttatggagaaacaatccggaatctgtcaatggaggagcgcatgacgatttgtaatatgtcgattgaaggtggggcgaagatagggctgattgcccctgatgaaacaacctttgcttatgtcgcgggtcgggaatatgcacccaaagagctcgctgacgcaattgcagactggcaaacgctaaaaaccgacgaagaggctgtttttgatacccaactgactcttgatgcctctcagctggaaccttatattacgtggggaaccaatcctgagatgggagtgcctatcagtggagtctttcctgaaattcgtgaccataatgatgaacaagcttatcaatatatggcattgcaccctggacagcgagccgaagatattccaattgaatatatttttatcggttcctgcacaaatggtcgactctctgacttgcaagaagccgcaactattttggaaggaaaaaaaatcaaagatggggtcacaggcatcgtggttccaggatcacgtccagttagaaaagcggcagaaaaactggggttagatcagatctttaaagatgcaggtttcgaatggcgagagcctggttgttccatgtgcctaggcatgaatccagataaagtaccagcgggcgtccattgtgcttctacatcaaatcggaacttcgttggacgtcaaggtaagaatgcccgtacccatttatgcagtccagcaatggctgcggctgccgctgtttatggacgctttgtagatgttcgagaaatcgtcgggaggaaaaattaatggaagccttcacttactatcaagggaaaacgatcccattaatgaatgataatattgatacggatcaaattttaccgaaaaattatttaaaacgggttgaaaagacaggatttggtcaatacctttttgatgactggcgctatttaccaaatcgccgttcaaatcctgaatttattttgaactttccagaatacaaagaagcatctatcctcatttctggagataattttggttctggttcttcgcgtgaacatgcggcttgggcgctgatggactacggctttcgtgcagtgattgccggcagttttagcgatattttttatatgaatgcaacgaaaaacggcttgctgcctatcgttttatcgctttctgctcgtcaagtattggcagcattggctcctgatgagaggatcgctattgatcttcccaaacagcacgtaactgtcaaacaaacggtctatccttttgagatcgatgcaacatggaagcataaactggtcaatggattagatgagattggcatcacgttgcaagaagaagaaaaaatcactgcttatgaaaaaacaatccctcattatcgccgcaactaaaagacagaattgcgagatgctagtgcaagccatgctctctgatgcgattcaagccagaccaatcttgatggatccgttcagccaatgttcgattataaaaaatggcagcgggatgatacattggaacaatcaggtattgtttgtcagaccacgtataaccatttttttcagcattcaactgttggatcgcacttctgattggctgcccatgaacatttgtaatggaatagcgattgcctaataatctttgtaacccgatgtttccaaccgtagcaatcaaaggcggatccaccttttggatttcgtaatccaataaaggcgcatgcaacaagacttctttttttgttggcgttcgattggggtgcactacttcatgtgcgccacttcgtttgttgattcgttctttgatcgaatagggacggctccgtactgcactcgtgatatatacctcttcacgtgtcagtccgactaacgccaaagaggccatcagttctttgcctgcttggccactgaaaggaataaaattctcgatttcggtccgtccaggtgcttcaccaacgatcattaatttgggatgaagcggtccttgaccaggaacaaacccttcaagctgataggcttttgattgttcaatgattggctcagctagtttttttgggtagttcattttaacacctcatttgtttctttcttctatagtaaaacaacttacttaaaaaaaatagtaaagcggcatgacaaaaataaatcattatttttcattgactttacggaaacattttgataaagttaatctgttgtaattgtggactccacagctacaaccgcacagaacaagttattaagtacgaaagtcacttgggatggcgagtctaagtataatagaaggaggtgctttagagcatgtacgcaattatcaaaactggtggtaaacaagtaaaagttgaagtgggtcaagcaatctatgttgaaaaattagatgtagaagctggacaaaaagttacttttgatgaagtgatcttagtaggtggcgaatcaacaaaagtaggtgccccaatcattgctggtgcaactgttgaaggaactgtagaaaaacacggcaaacaaaagaaagtcgtaactttcaaatacaaacctaaaaaacattcacaccgcaaacaaggtcaccgtcaaccttacacaaaagttgttattgacgcaatcaatgcataattcttacgaaaagtagggtaacgaatatgatcaaagggacattcaagcgtaatgactctggtcggattgtttcttttgaacttaccggtcacgcgcaagcaggagaatatggcaaagacatcgtctgcgcagctgcttcagcattagcgatcagtgcggtaaatgggatcgatgctttggctggtgtaacaccaatcgttgaagcgaacaatgaagaaggtggctaccttcttgttaaacttgttcctcgtttgacccaagagcagtcgaatatctctcagattcttttagagaatctattgattggtctgcaatctgttcaagaagaatacagcgattatatccaaattaaaacaatcaaagaaaactaggaggtgcatctcatgttgatgaaaatgaatttgcaattcttcgctcacaaaaaaggtggcggttctacttctaacggacgcgactctcaatcaaaacgtttaggtgctaaacgtgctgatggtcaaactgtttcaggtggatcaatcctttatcgccaacgcggtactaaaatttacccaggagtaaacgtaggtatcggtggagatgatacattatttgcaaaagttgacggtgttgttcgtttcgaacgtaaaggccgcgacaaaaagcaagtttctgtatacccagtagcgcaagaagcttaataatacagttagatgatttactatatccttagtaagtcatctttttttattcggtttgtttgaaagcgatttaattagaggaggtctgaaatgatccggctaaaaccaatcacaaaagagaattatcgtggctgtattgaactaaaaacaaccaaagaacaagaaaaatttgttgcgcctaattggtattctttgctggaagctgtatatgaagaagctcggcaggcttttgcgatttatcatcaagaagaaatgatcggtttcttattgtttagttattacgaagcggatgaagattatgcaaaagaatcatggtggatcgagcgttttatgattgatcatcgctttcagcaaaaaggatatggatcacaggcaatggaagcagcgattgaatggttccggcaggcgatccaagcaaaagaactacgaatttcttccgttaaagaaaatacgatcgctaaacaaatgtacgaaggttttggatttgttgcaactggagagtttgtaaatgatgagaccgtgttgttgaaagaatggagataatctggttgaaaataaactcatggtggtgttggatgtgaggagccgacagccatgagtttttttgcacttgaaagactgctgttgtaagtccggggaagaataggcgatcgtcttttcgatctgtctcttcaaacttttgttttggtaatcttggtcaaactagttaccggtagatgtgaagagagaattatagcctcaaaagtagagaatttcctgattgatgacatgtccaatagatcacaactatcttcgagaggattaacagaaactttacgtgttgtaaatacaaacaataaattgctttggtactctttttaaagtagagcaaagcaattgacagactgtgaaatactctttgattgagaaaaggtacacaagttaatgttcgtgattagattgattttactaaaaaatatccatttatagtgaaaaaatagttgtaattaaatgtacgtttttctataatcaaaaaggtaaagttcgttaattggttgttctgatttttaacacaaaggagaagaagaatgaagctttggaaaaaggtaggaatcgttggattagggttagcaactggattggcattagcagcttgcggagcgggagaatctagttcgagtgcagaggaacaatatgttccagaaaagttgacagttcaatttgtgccctcgcaagcagcagaaacgttagaggctaaagcgaaaccgcttgaaaagctgctaagtgataaattaggaattccagttaccgtaagtgtttcaacagattacaatacgatcgtcgaagcaatggcttctaagcaagtggatgtgggctttttgcctccaaatgcttatgttttggctcatgaacaaagcaatgtaaaagtattactgcaggcacagcgatatggaatcaagcagcctggtggtgaagcgacagatgaattggtggatagctatcgatcaatggttgtggtcaagagcggcagcgatatcaaggaattagctgatttgaaagggaaaacgatcgctacacaagatgtaacctcttcggctgggtatgtttggccagttgcggaacttcaaaaagaagggatagacatcaataaagatgtaacgacagttcaagtcaaaggtcatgaccaagcagttttggctgtcttgaacggagatgtagatgcggctttcgtttttgaagatgcgcgaaatacagtgaaaaaagattatcctaaaatcatgaatgacgtggaacctatgtatttcacagaaccaatcccgaatgacaccattagtgttcgcagtgatatgagtgaggaatgggacaaaaaaatccaagatgcctttatcgaaattggtaaagatgaagaaggtcatcaaatcatttcagatatctactctcatgaaggctatgtagtctcccaagacagtaattttgatatcgttcgtgaatatgcagaacaagtaggacaataagcggcagagaaagggtatcgtatcaacagatacccttttcaattttataaaagtagtttaatgagagaaagtaggagaaccatggcgttagcaaataaaaagatcatttcgtttagaaatgtgacaaaagaatatccaaacggtgtgctggggttaaaagatttgaatattgacatcgatcaaggggagtttgtgatcgttgttgggttgtctggtgcggggaaatcaaccatgctgcgttccatcaaccgcttgcacgaaatcaccagtggcgaaattttgatcgataatcgctccattacaaaggcaaagggcaaagaattacgtttgattcgccgagacattggcatgattttccaaagcttcaatttggtaaaacgttcgagtgtcttaaggaatgttctcactggaagagtcgcttatcaccccactcttcagatgcttttgggattgtttccacaagcggataaggaactagcttatcaatcgctacaaagagtgaatctagccgaaaaagtttattcaagagccgatcaattgtctggtgggcagcaacaacgggtctcgattgcacgggcattgactcaggaaccaaaaatcattttagcggatgagccggtagcttctctggatcctatgacaacggagaaggtcatgagtgatttaaagcggatcaatcaagagttaggtattacgatcgttgtcaatttgcattccgtgcaattagcgcgagagtatggtacacggatcattgggttacgtgatggttgccttgtttttgatggaccagttagcgaagccactgaccgaaaattaaaagaaatctacggcagtgagattatcgaagagcaaggaggcacagaaaaatgaccactcaattgttgcctaaacgaagcggactatggaagaatattctttggttggtgctttttttgctcgtcttgattttgagtggatcgattacgggagtcgatcttcgccgtttttttgaaaatgcggatcaaatgaacgtgatactgataaaaatgctgcgaccagattggtcgtatagtacgatcattgtggagcctcttcttcaaaccattcaaatggcaattgtcggaacaacgtttggggcgctcattgctttgcctttttctttgctggcagccagaaatatcctaacaattccttggttatcggggatttttcgctttcttttgaatatcgtacgaacgattcctgatttgatgttggcggcgctgttcgtagcagttgtcggtattggtccggtagctggtgtgacttcaatttccatcttttcttttgggatgattacgaaattattttatgagtcgatcgaaacaattgaagcgggaccgatcgaggctgtcaccgcttcagggggatcaaaactggcgattatccgttacgcggtacttccgcaggtaacgagtcattttttaagttatcttttgtatgcctttgaaatcaatgttcgcgcctcaacgatcttagggtatatcggcgcgggaggaatcggtgtctttttgcaacgatcattgagtcaatttcgctacgaccaaacggcaattatcgttttggcgatttttatcgttgttcttcttatagataccatcagtaatagagtaagggagcgattgctatgatgttgccaacggaaccccagaaaaaaagaaaatggcttttcgtgctcgttctggttgctatttatatttgggcatttgcaggaatccccttagctactatcaaagaaaacgttggtcaaatcttaggggcaattttctacggattgatccatccggattggagttatgtctataccggggatggcgaagatttgttcagtttaatgattgaaacggtagccatcgcttttgttggtacatttatttcttctttattaagtattccttttgcgttttgggcagctcgaagcaaaaatacacctagattcttgtcgggcacaggaaaagtcgtcttaacagcgattcgcacgtttcctgagattgttctagccatcatgtttattaaaactgttggtccaggatcttttgcgggcgttttagccgtcagtgtccattccataggtatgttggccaagttatatagtgaagcgatcgaaaatatggatcagggaccttctgaatctgttgtgagtgctggcggaaatcgctgggcggttttaggatttgcgactttaccgcagttgattccagagtttttgtcgtttactttatatcgttttgaattagctgttcgctctgcatcgattctgggaatagtgggagcaggagggattggtacaccgatgatttttgctatcaatgcacgatcttggagtcgtgtgggcatcattttgcttggtattattttgacagttacctgtattgattttatttcggggcgtttacgcaaacgattggtctaagaataagaaatagggcaattacacacagctctattcgattcaattggagattcggtcagagttattcgcggtggtttgcacaaaagacaaatctggtggctctttgttatactaaaatgtgaaacgaagtagcattaaggaggcagaggagatgaaagcactattgatcgtcaatcctagttcgggaggcgaaaaagctgcaggatacgaggaattagcaacaaaaaaattgcaggaactatttgatgaagtggctgttgcacacacagaaaaagcgggtgatgccgagcggttcgcatctgaagctgtcggctccgtggatagcgtgtttgcaatgggaggtgatggtacagttaatgaggcgatcagcggaattgctagtcatgaggagcgtccgcgttttggctttttccctctaggtacagtcaatgatttggctcgtgcattggccattcctcttgatcctgaagaagcaatcgaatcattttcgttgaatcattctcgcaaaatcgacattgggaaaatcaatgacgattatttcatgaatgtagtggcgatcggcatcattccagcagctatcaacaatgttgaagttgaagaaaaaacgaaacttggaaaaatggcttatttcctttccgggttgcgggaagtacgcaaaaatgaaagtcatcaatttgaaattatcactagtggtcaggaagcaacagaaaccaaaattgaaagcagcacactgatcgtaggatcgtcgaatacgatcggtggttttgaatcgctgttaccagaagcgagtacgaatgatgggaaattgcatcttatctacattaaagacagcaatctttgggaaaccatcaagagtattcccgaactgctaaaaggagtaacggaatccaacgaatcccttggatatctaacgtttgagaaagcgcagatcaaactactggatgatacaacgatcgaaaccaatgtcgatggagaccctggtccaagtctgccggttgagatccaagtattaccacaacatattactgtgttttgcgggcaagaaaaaaatcaagcgtaagctagtgggtaaagatgatccttgtttttagacaaggattgtcttttttttattagaaaggtatactgataaaaatttgaagaaagaagggaatatatgaacattcgaaaggctgctgttgcagataccaaatcattgttaaaaatttatgcgccttatgtagatcatacggctattacttttgaaacagagataccaactgaggaagagtttgcgcaccggatcactcaaacgcttcagcattatccatacttgattgctgaagaaaatggtgtcattcttggctatgcttatgccaccgcttacaaaacacgagctgcctatgactggacggcggaagtgacggtttacatcgatcgagaagtaaaagcaaaagggataggaacgatgctttatcatcatttggagtcagagttgaaaaaacaaaatatcgtaaatttgaccgcttgtatcacggctgggaatgaaagcagtgtgaggttccatcaaaaatttggttacaaagaagttgcatatttcccacaaattggctataagtttgagcagtggcacgatgttttatggatgcaaaaagagttgcagcagtttgttggtgacgtgccaaaatttattccctacccattgacacaataatcatagcattagattgtcttttttttgctaaatgctttattcttaagttaatcaaaaggtgctatgaaaaaatggttagtgctgtatgctgcaagatttttcaaggggcgtgtttaagggtggctaggttattggctggtttgagtagggaaagtattcagaaaagatttgcaatttttattcaaacccattaaagtattcaaggataaaactttcaaggaggcggagctgttggggaaacggattgagcgtatttatcaatttttattggaaaatacagaaaatggcttgaatgaaaagggaacgacgacatcagaggtcgctgatcaattgatgatccaacgaagcaatgccagcaaagatttgaatcaacttgtcaaagaaggccgcgttcaaaagagtgatacccggccagtgaggtattgggtagctcaagatgcacggtctgggcctgagaaatatgttccaagttataaagagaaccgcccccaaagagagaaagctacgccgcagcgagtggatgtcaaattgggaaaccgtgatattttttcaacgatcattggtgtgaacggcagcatgaaaaatgctgtcgaacaagccaaagcggcaattctgtatcctcctaaggggctaaattgtttgatcactggaccaacaggttcagggaagacgtattttgctcacgccatgtttcagtttgcgaaaagcaatcaggtgatcgaagaggaaaaagagttgatcgttttcaactgtgccgattatgccaataatccagagttgcttatgagccatttgttcggttatgttcgcggtgcttttaccggagcggatcaggagaaaaccggaatcattgatcaggcggatgaaagtatgctatttctagatgaaatacatcgattgccgcctgaaggacaagaaatgattttttactttatggatcatggaacctttagtcgattaggtgagactggtaaaaatcatcaagccaatgttcgcatcgtcggagcaactactgaggatcccaattcgacattgttggacacttttactcggagaattccgatcaatatccaactgccgttttttgaaaaacgacctgcctcagaaaaagtggatcttgttcgggtacttgtaggacaagaagcaacacgaatccaacgcacgatcacattgactgaagatgtcgttaaagcgttgattggcagtgtcagcttcggaaatattggtcaattgaagtccaacgttcagttggtctgtgcacgagggttcttgaatcatatgcaacaagatgaaatcgagattgatttggacgaacttcccgaaggaatccgctcaggattaatggtcttggggaatcgccgagatgagttagcagagctgtccaaaattcttgagccgactgtgcgtgttcaaccaaaccaaaatcttaataatattcaatccgattcttatgaattaccgtataatctttacgatattatcggcgataaagctgctttattaaaagcggatgggctggatcaagaagccatcaatcatttcatatctacagatatcaatgttcatttgaaatcattttacaaagatcacggcttttctttcaattcagaaaacaaattgagcgagtttgtggatcaaaaagtgatcacagtgacaaatcgtatttatgatctggtacgcacaaggctgaactatgaatttcagcaaaattttgtgtatgcgatgagcttacacattagttcttttttgaaaaaaattcatctgggagaagaacggcataccaatgacaatattcgtcaaatggtcgccgactatccgaaagagtttgaagttgctaaagaaattcgtacatttattggtgatagtttcaaagtatcgattcctgaaagtgaaacctattatttggctgttttactcgtatctttgcggactgcccattcctctggaaaaattggtgtagttgtagcagcccatgggaacagcacggcaagcagtatggttcaagtggttcaacaacttttagaagtggatcaagtggcagcagtagacatgcctttggacatgccgcctaccgttgcattgaaaaagatcgaagaaagtgttcaagcagttaatgatggtagcggcgtgattttattagtagatatgggatctttagctaccttcaacaatgagattcagagggaaacaggtgtgattgtacggactgtcgatatggtgacgacatcaatcgttttggaaacagtccgaaaagcctcagttatcggcacggacatcgatagtttgtatgaatcgcttagaaaatttcgcggctatggttccgttgaacagccggagggtcacttaagcaatcatcatcgcaaagccatcttagccatctgtgcctcgggtaaaggaacggctcagaggatcaaagaactaattcaaagttccctctcgaaacgtcaaaatcagaatgtagaggttgtgacactttcagtggctgatttaaagactgagttagaacccatacaaagacaatatcaactgatcgccacgacagggatcatagatccaaaaatcgatgcgccttttatttctctggaacgattcattgatcaagatgtagatcaattgttggaagaaattttgttagagaatgatctgagttttgaacaagacgttgaacttggtgaagaacaagcagaagaaatttgttttaaatatatggagcaaaacctgacttttgtcaatccgcgaaaagttatcgagccattgtggcaatttggccatcaattgatcaatgatttagaattgacggatgcaataccagggtttcaaatcaattttgtgctccactctgctggaatgatcgaacggatcgtattaaagcaacctttaactgtcgatgaaccccttgtttctgaactgaagcaagagccgatgtacaaaaaacttcacatccatgttcgctcgttctcgcgcttgttaaatgtagaaataccagaaagcgaagaatattacttagcagagttgattaaaaatcatcaagaaaaaacggttttggctgatcaataatacattaagaatagaatacactaaaaaagatacactttttttcagtgtatcttttttagtgtatcatcaagaggccgattcttaagcctttccaaagattagtgtattgtataaaagttggcacgcttcttgcttctatataagtggatacaggaggtgaatgaaaaaagtaagggatccacaaatagccagcggatcgatggatgtaggaggtttttacgatgggaatggatatacgtcttgctcgaatcgatgatcgtttgattcatggtcaagtagcaacagcctggtcgaaaatgactggtattaaccgaatcatcgttgtcagtgacgaagtcgcaaatgatcagcttcgcaaatttcttttgaaagaagccgctccgccaggaatcaaatccaatgtcgtcacagtggcgaaaatgcttgaggttgcacataacgcattatttgatacccaaaaagtcatgttattatttaccaatcctcaagatgttgtcacactagtcaaaggcggattaccgattcattcaatcaatattggaggaatgagcttttcgataggaaagcggatgatcactaattttgtttctgtcaatgatcaagacctcgaatcactgctttatttgcagaaacagggcattgaagtcgagattcgaaaagttcctgctgatcgtaaaatctatttgatggatattttggaaaaagagggtagtcacacttgatttttcgtcgttgctttttttctttcatttaagtgtcacatttatcaattttgaaataggaggtaaaaagatggtaggaattatcctagcaagtcatggagaatttgcaaacggcattttgcaatctggttcaatgattttcggcgaacaagaaaatgttaaagctgtaacattgatgccaagtgaaggcccagatgatatcaaagcaaaaatgcaagaagcaatcgccacattcgacgatcaagaagaagtgttattcttagttgatctttggggcggtacacctttcaaccaagcaaacagcttgtttgaagaccacaaagacaaatgggcaatcgtagctggtatgaatttaccaatggtcatcgaggcttacgcttcacgtttttcaatgaatacagcacatgagattgctgcacatatcattgaaacagctaaagaaggggtcaaggtgaaaccagaagaacttgaaccggcagaagctgctgctccagttgtggctgacgatcaacctaaaggatcacttcctccaggtactgtactgggcgatggcaagatcaaaattgtattggctcgtgttgactctcgtttgcttcacggacaagtagctacagcatggacaaaatcagtgaatccatcacggatcatcgtagtatcagatgcagttgcaaaagacgacttgcgtaaaaaattgatcgaacaagcagctcctccaggagtaaaagccaatgttattccagtagaaaaaatgatcgaagtgtcaaaagaccctcgttttggtaatacgaaagcattgctattgtttgaaaatccagaagatgtattgcgagtagtagaaggcggcgtagacattcaagaagtcaacgttggttcaatggctcactcagtcggaaaagttgttgtaagtaaagtattgtctatgggtactgaagacgttgaaacgttcgaagaactaaaatcacggggcatcaaatttgatgtgcgtaaagtaccaaacgattcacgcgacaacatggatgaaattttgcgtaaagcgaaaaacgaattgtcgaacaagtaaaaagtatacaactaaataggaggtctatcatgtctattatatctatggtattagtagtagtcgttgcctttttagctggtatggaagggatcttggatgaattccaattccatcaaccgctagtggcatgtacattgatcggtctagtgaccggtaacttagaagcatgtattattttaggtggatcattacaaatgatcgcgttaggttgggcaaacattggtgccgctgtcgcaccggatgctgcattggcatctgttgcatctgcaattattttagttttaggtggacaaggacgtggcggtgttgacacagccattgccgttgcgattcctttggctgtagctggtttgttcttaacaatgatcgtacgtacattagctgtaccaatcgttcactttatggatgcagctgctgaagaaggtaatatccgcaaaatcgaaatgtggcatgtgattgccgtatgtatgcaagggatccgtattgcgattccagcagcagcattgctagcaattccagctgcaactgttcaaaacttcctagaatctatgccagcttggttaacagatggtatggctatcggtggtggtatggttgttgccgtaggttacgcaatggttatcaacatgatggcaactcgtgaagtatggccattcttcatcattggttttgtgattgcagcgatttctgaattgacattgattgcgatcggtgcattggcagtagctattgcattgatttacttgaacatcaccaaaatgggcggatcatcaaatggaggcggcggcagcaacactggcgaccctctaggcgatatcttgaatgactattagaatcgaaggaggagaaaaaaatggcagaaaaaattcaattaagtaaaaaagatcgtttagccgtagcatggcgctctaccttcattcaaggttcatggaactatgaacgtatgcaaaatggtggttgggcattctcaatgattccagcaatcaaaaaattatacaaaacaaaagaagaccgtgccgctgctttgaagcgtcatttggaattctttaacactcacccatatattgcttcaccaattctaggggtaactttagcattggaagaagaacgtgccaatggagccgctgtcgatgatgtagcgatccaaggggtaaaagttggtatgatgggtcctttggctggtgtcggtgaccctgtattctggtttactgttcgtccgatgttaggagctctaggtgcttctctagcgttaggaggaaacatcttaggcccaatcatcttcttcttggcttggaatatcattcgttgggcatttatgtggtatacacaagaatttggctaccgtgccggatcaaaaatcacagatgacctttcaggtggtttgctgcaagacgtaacaaaaggtgcttcaatcctagggatgttcgtattaggatcgcttgttcaacgttgggtatcaatttcatttgcaccagttgtatctcgtgtccctcttgatgaaggagcatatgtggattgggcaaaattgccatcaggtccagaagggttacaacaagcattccaacaagtcgctgaaggccgtgcattaacagatacgaaagtaacaaccttgcaaaacaacttggatcaattgattcctgggttggctgcactattacttactctgttatgtatgtggttattgaagaaaaaagtttctccaatcatcatcattatcggtttgttcttagtcggtatcggtggacacttgatcggattgttctaatctttcaactaaaagtgcttggggaaacccaagcactttttatctattcgccaaaaatcatcagaacaagtataataagaaacaataagacgtagaaatggagcaaacaaattatggtacaatccctgaacaccaaagttgatttgacgatcgatgcgacctcatttttgggtatcaacgaatatggcaaaattatgatcggcgacaaggcttttgaattttacaacgaccgtgaccagcggaagtttatccagattccttgggaagatgtagattacgtgattgcctctgtcatgttcaaaggtcgttggatcccaaggtacgctattcggacgaaaaaaaatggcacctatactttttcttcgaaagagcccaagaaagttttgcgggcgattcgcgtctatgttgatccggatcatatggttcattctcttggctttttcgatgtgctaaagcgggcgttcactcgcagaaaataacatgcaggcatattcttgttcaaaccataattgatgtggtacccttttattagaaagtttaggaggggtattatgcattttttatggacattgatcgtaggtgcggtcatcggatcaatcggaggcgcaatcgctggtgagaaacgcggttgtatctttgatatcgtagccgggctagttggggcatcgattggtcaagcactatttggaacatggggaccacagattgctggaatggcaattgttcctgccattatcggagcggtcatttttgtcgctgttgtttcgttcttcttgggacgtagaaaataacttacagccattcattttttaatgaatggctttttttttgtgactttttctctgtgagttcgtatagtaggtatggaggggtgactgagttgggagatgaactgttagcaaaaatatataaagattactcgcaagactgttatttgtatgcgttttattttacaaaaaataaagagcaggcccaagatttagtcagtgaggcgtttctcgtcatagcggaatctctcgatgagctaaacgaaaagcaaatcaactattttttactaaaaataatcaaaaatcgcttcattgactggacgcgtaaacaaacggtggcacatcgatggcgaaagtttccttcacacgtttttcaagcagaaagccaacagttgtctaccccattggaagaaataataggacaagagagaaaaagagcattgtatcgcagtattgagaaattacctaaagatacgcgagaagtgattttactatactattttttggagtggcgaattgaggaaattgcaacgtataaagaatggagctacacgcaagcgaagaatcgtttgtatcgaggaagacaattacttaaggaggaattaacaaatgaatgaaccatttcactttgaacaattgcaaaggaaaatcaaacaacaacgttacaaacgagggattttctttctttttgcagctgttgtactgacaattgcagttttacttgtaatgccaaaatttgttgacctctttttctatgatcctcggcaaagtagtctacaagtaaatcaagatagttacatcatgaatcgtcaaatcaataacgagttaacgacgcaaaatcattttctatcgaagtatgaaatacgttcattaggttttggcagttatgaggtgacagaagtttatcaaaatctcgatcagaatcattctacgattcagacagtaacgatcgataaaaatcacttgctgaagaattatctctctaattcgcaaaaaaaagattttctttttgaatcacgtatgcgagattcatcgagtcttgaattctctgagaatcagacaatgaagcagaaccttttgaacaatttaaaaaaattgcccaaaagcacttcattgatcaccacattaatttttgagaaagacttatctttggaagaattgagagactggcagatgtatcaaatacccaaaggagaaattctctggacagctgttcgaacagggggggcaactggaaatcaagattttcagccgcttgggttttccaatagtttttctcgtgtagtcccagaagaaaagacacttgaagagagttttttaaaagactttccttttctggatttatcagaagcaactagcaaacaacaatcagactattcagaaacagaacaatccgctgcgcattttgaatcgatgttgaaatacttactaacccagaaagactttttagccttggaatcgaatgacgcgcgtgatattctatctgttgaacaaattgaaacagcgttgacctacattcaaaaaaacggtgtacaaacctatggaatttcagcacgcatgtccgtagatgcactgattacccttcttgaaagcggtgaaaacattttaacggcgcgtgtgatggagacgaatttgttttctttgatagaccagattaacgaggattaaagaatgtctaaaagcaatctgtctttttttgtataaatttttttcattcttttcgcttttctgggaagtttgctataataatacagaacaagaaagtggggagaaagaatgttaagagttgaaaaattaagagaagcaatgagaaaagatgccgttgatggttttttgatcacgagcccatacaatttgcgttatttgactaattttaccggcacgactggtttagctgtcattacattggaaaaagcttttttcgttactgattttcgttatacagagcaagcggctgctcaagcacaaggatttgaaatcgtaaaaaatagcggaccgatttttgaagaagttgcggctatttgcgaaaaagaagagatcaatgttttggctttcgaagaaagttacgtcagcttttctgattattcggtcttggaggagattattgaagaatcttcattggctcctgtttcaggtatgatcgaagcattgcgggaagtcaaagatgagtcagaaatcgcgttgatccaacaagcttgccatattgcggatcaaggatttgaacatattttgaaaatgatccgtcccggaatgtcagaaatagaagtagccaatcaacttgactttttcatgcgttctttgggcgctacaagcgtttcttttgatacaatcgttgccagtggattacgttcagctatgccccatggggtagctagtgaaaaagtaattgaacaaggagatttgatcactctggattttggttgctactatcaaggatatgtttctgatatgactcggacgttcgccgtaggtgatcccggagacaaattaaaagaaatttaccgaatcgtccttgaagctcaagaaaaagttttagctgcagccaaaccgggcatgacaggaattgaattagatgcaatcgcacgtgatcatattgcttcattcggctatggagaagctttcggacattcaacgggtcacggaatcggtctagagatccatgaaggaccaaacgtctctttccgagcagacaaagcatttgttacgggcaacgtcattacagacgaaccgggaatttatcttccaggtatcggcggcgttcgaatcgaagatgatttgttgatcacagaaactggtaatcaagttttgacgcattctcctaaagaattgatcatcttgtaaatcaacatcctcgtttatttcagaaaattcattgagaatagtgggttattatagattctcagtgcagaaaatgataaacttagggcgagaagaaacctctatacaaatgaaactgtctatccaagtcatgacttattgagacgaaacatatcgtgaagggatagataacaatgtgtggaagtttagaatggaggcaaaacttatgaatgaagataaaaatctagtcttagacgcaagtcctgaattaggcgaaattgtgatcgcaccagaagtcatcgagatcattattggtatcgcagcatctaaagtggaaggtgtctatgggatgcgggggacattagccaatagtgtgactgaattgcttggacgctccgcgcatggcaaaggggtctacttgacaatcgatgaaactgggatcaaggttgatctttattgctatctaagctatggcgtttctgtgcctaaagtagcaatggaaattcaagatcgagtgaaacagcaagtattgttcatgacagatgttcacttagcggaagtcaatgtccatgtggtagctgtagtaccagaaaagattgagcaacctgatattgaagaattattcggaaacgacgaggaagaaaatgagtaaagaattatcacgtcacgagattcggaaaatggctctgcaagccttatttcctttagattttaataaagatttaacgaaacaagatgcgatcatgcatgcaattgagttggaacaccatgagctgattgatgaagaacaggaacacttcgttccagcgtatttggatcaacttgtagcaggggtatgtcagtacaaagaagcgttggatgaagtgatccagtcccatttaaaatccggttggaagatccaacgattatcaaaaatggatgtaacgattttacgaattgcattatatgaaatggtgtatgttgacaatgttcctaatcgagtcgcgttaaatgaagccattgaattagccaaaacattcagtgatgaccaatcaagaaaatttgtgaatggtattttgtctaatgtcaacagtgaaattgaaagtaagaatgactagttaatcaaaacagcctcagctaaaagctgaggctgttttttggttatttgcgatacaatgccatagttgttattaagttggttgaggtgaaaaactggatctttctacagagagaagtgttaataaaagtaattttttcaaaaaaacagctgaaaaataaaaataaaagcgatattttgaataaaagtattgactttagaatattctgacgatttaattgaaagtaataattgaaaggagtcagaaaaaatgaaaattatttcagcggataatgggaaagaatttgaaacgatatttgattcattgaatcaaaccaacggaaaggttcaaatgggagtggttcggttagctccaggtgagaaaagaccattagagggatttgcacgtcacacacaagatgaattttcctatgtgatcaaaggaagcgctcatatagttttagaagacggaacagatctcactggaaatccgggagactgtcaatggatcgaagccggagaagggcatatcaactacaatgatggcacagaaacggctgaggctgtgtggtttttggtggaacgataaaaaaggaggaaaagaatgagaaaaggatttaacagattgttggggttgatagtagcaatgatatttttgactggatgtacagcaggtacaacaacaaagcagaaagaagattcagcctctcaagtgattcgactaatgtctatgacagagctaacttcattggatccggctgccatgttggacttcccagatgcaattattcaaacagccacttttgaaggcttatatctattggatgaaaaggatgaagtgcagccgggtgtagcagttgatttaccggaaatttcgtctgacggcaaaacttatcgctttaggttacgcgaaaatgcacaatggagcaatggggatccggtgacagcgaatgactttgaatatgcttggaaacggatgattgatcctgaaaatgcatttcagtatagtttcttgatgaatggattgatcgaaaatgcggaagaaattgcccgtggtgatcagtcggtggatacgctaggtgttgaagcaaaggatgactatacattagaagtccgtcttacacaaccagctccgtattttacttccttgatggtttttccgattttctttcctcaaaatcaatcggttgtcgaaaaatttggacaggaatatgggacagccagcgacaaaattgtttataatggaccatttgttgtaaaaaactggcagcaaactgagatgaattgggatttagccaagaatgaatcttattgggatcaagaagctattctggcagaagagatccattatgatgtggtaaaagaatctgcaaccgcgctaaatctttatgaagatggacagttggatgtcgcaatcatcagtggagagatcgccaaacaaatgcagtcaagtgaccaatttgcctcttatccttcggcaacgatgaattatatccggttaaatcaagaaagaaagggacaaccgacacctttacaaaatgaaaatttacgaaaagctctcgcattggccattgataaagagaatcttgtcaataatattatggcagatggatccaaacccttgaatggcgcgatcacagaaggctttgtcgctaatcctgatactggcgtggactttcgtgaggaagccggtgatttgatggcctatgataaagaaaaagcgctagcctattgggaacaggcaaaagcagaattaggcgatgaaatcgagcttgatctgttaacgactgatgatggttcctacaaaaaaatgggtgagagtatccaatggagtttggaggacctctttactggtttgaaggtcaatatgcgctcgctgccagccgaaacagcgttgaatcttgctagtgaaagcgactatgatttgttcctaatttattggactcccgattaccaagatccttattctacacttaagatgatgtatagcggaaacaatcgccattactcgaatcctttttatgaccgcttattggatgatgccagcactacctatgctcttgatgagaacaagcgatgggaaacgatgattgcagccgaaaaagaactgatggaaacaactgccggtatgatcgttatcagccaaaatcaaaactcagtgttacaaaatccttcaatctcaggattaaactatcacacttttgcggcaccgatgactctcagaaaccttgtgaaaaatgagtgaagaatagctgatcaatcagactcattatatcaaaactgcgggttttgaattgattaggtttctacaaataaatagtgaaaactaggcagtccttttgcaaaagaggctgcctttattgttctgtgtgagtctttggttaagcagttgcaatgagaaaatgctatgatactagagatgggaaacgatgattttcctaccagaaatcatttttcttcaaagcgaactatgctagaatagaaaaaagtcagaggagttgtcaagatgggtattttgattaatggaaaagaattagcagaaaaaatgcaagcagatcttactgcagaaaccgcccttttaaaagaacaaggaattgttcccggcttagttgttctactggtaggggaagataaagcaagtcaaacgtatgtgcgaaacaaagaactggctgcggcaagaatcggcatacgatctaaagttgaacattatcccgagtcgataactgaagaagaactacttagtgaaatcgacaagtacaatcaggacccagactttcatggtatcttagtccagctgccactgccaaaacaaatcgatgaagagaaagtgttgctagctatccgacctgaaaaagatgtcgatggtttccatcctatcaaccttggtaaattgtttgctggtgttcccgatcgaatcccttgcaccccttacggtattatgaaaatgtttgaagcgtatgatattccacttgaaggtaaaaatgcattagtgatcggccgaagcaatatcgtaggcaaaccgatggcacatttgcttctcggtaaaaatgctaccgtcacgatcgcacattcaaaaacacagaatttaccagcattggctagacaagccgatatcttagtggttgcgattggacgcggtcattttgtaactaaagaatttgtgaaagaaggagcagtcgttattgatgtaggaatgaatcgtgatgaggcaggaaaattgattggggatgtgaaatttgctgaagttgaacctatcgcaagctatatcacgccagttccacgaggcgtcggaccaatgacgatcacgatgctgatggcacaaaccttagcagcggcaaaggagactgtaaagagataacatggcacaacaatatttaactgtgaccgcattgaccaaatacttgaaacgcaagtttgatgctgatccttacttggaacgggtctatttgactggagaaatctccaattttcgcagacggccaaaccatcaatattttagcttaaaagacgatggcgcaaaaatttcgacagtcatgttcaagggagcttttgacaagctgcgatttcagccggaagaaggaatgaaagtgttggctgttggccgcatttcactctatgaggccagcggaaattatcagatgtacattgaacacatggaacctgacggagtgggggcgttgtatcaagcctacgaacaacttaagaaaaaattagcagaagaagggctattttcagctcccaaaaaaatccttccacgatttccaaaacgaatcgcggtacttacaagccccagtggcgcagtgattcgggatattatcaccactgcgcagcggcgctatccgattgccgaaatcgtcttgtttccaaccgtagtccaaggagacaaggcagcagatgatgtagtaaaaaatatccaacgagtagaagcagatggcaccttcgatacaatgattattggccgcggcggaggttctatcgaagatctctggccatttaatgaagaacgcgttgcacgtgccatattcgctgccgagacaccagtcatttcttctgtgggacatgagacagataccaccatcgctgatttagtggctgatgtacgagcagccacaccaactgctgctgctgaattagcagtgccagttctttcagaagaaattttacggatcgaagagaagcaaacaaggcttgaacaagcatttatgtatcaaatccagcggaaacaagaacgtttccaacgggcagtaggttcttatatttttcgtcaaccagagcgcttatatgaggcccaagcgattaagctggatcagttgcagcaacgaatgaatcaatcgttgcaaacacagctctatgataaagagaaggtggccagtcagttgattcatcgtttggaacaacagctacctaaggcacggctatcagctgcaggacaagaagttacttatttaacgcaacgactagaaaaagccattcaacttagcgttgaaaaaaaagaacagcgatttttaagtgctctccaatcgttagatcttttgagccctctaaaaatcatgggacgaggctacagttttacgacgaaagacgagcaagtcgttaaaaccatcgcagatattgaagctggtgatgagttgaacgtccattatcaagatggtcaagcgcttgttaaagttattgcaacagaaggagaagatcatggcaaatccaacatttgaagaatcattacaagaattagaacaaatcgttactcagctggaacaaggcgatgtaccattagaagaagctcttgacgcttttcaaaagggaatggtattaagcaaacagtgcaaagatacattggctaaagcagaaaaatcattaacaaaaatgatgactgaaaacaatgaagaagttctttttgatgaggaagactaatggataacatgcaacaatttcaagaaaaatatctttcggagatcgaagctgtgattgttcgatttctagaagagcatacaagtgatcaaacgttgaaagatagtatgctctactccattcatgctggcggtaaacgaattcgtccactgctgttgacagcgaccgttgcttctttccataagtcaatgactttgggagtataccagactgcagcagccctagagatgattcatacctattcactgattcatgatgatttgccggcgatggacgatgacgccttgcgacgaggcaaaccaacaaaccataaagtctatggagaagcactagcaatccttgctggggacggtctattgactgctgcgtttcagttgttatcgttagctgatcttgaaccagataagaaaattttgcttttgcagcagcttagtcatacggcaggcacagcgggaatggtggctggacaggcagcagatatccaaggggaaaatcagcaactcacacttgatgagctgatcagcattcacgaacgcaaaacaggtgaactgattcgttttgcagtgattgcaggtggtattttagcggatcagacagaagaagttatccagctgctcgatcaatttgctcgtcatatgggcttagccttccaaatccgcgatgatcttttagatgtcaccagtacaacagaagtattgggcaagattgtccatcgagatgatgcactagctaaaagtacttatccggctttgctaggacttgatggcgctagtgaagcgttgaaggatgaattgaatcaagcgtatgctgtgttagatgaactgagcagttatggacatttcgatcaacgattgatcacatccgttgtcaaacaattcgagattagaggaaagtaatgaaaaaagaacgagtagatgttttagcggtccaacaaggactttttgaaaccagagaacaagcgaagcgcggtgtcatggctggattagtttacacagagaaaaatgaacgtttagacaaaccaggtgaaaaaatcagcggggagacacagttgcaaatcaaaggcaaaaagctaccttatgtctcccgtggtggcttaaaacttgaaaaagctttgaaaatttttgactttgaggtgaaagaccaaattctgctggatattggtgcgtctaccggcggctttactgatgcagctctgcagaatggggcaaaaatgagttatgccttagacgttggctacaatcagttggcgtggaaactacgtcaagatccgcgagtagtcgtgatggaacgtgtgaattttcgttatgccaaacctactgattttttagaaggattaccagaaagagcaaccatcgatgtgtcatttatctctttgaagttgatcttgccgccgttacatgaaattctcgtagaccaaggagaagtcatagcgctgatcaagccccaattcgaagcagggaaagcatctgtcggaaaaaacggcattgttcgtgatcctgcagtccatcaaagggttctcgaagaaatcttggactttgcccaatcgaatggctttaatattcttgatcttagtttttcaccgatcacgggcggtgaaggcaacattgaatttttggttcatctacagaaagtgcagaatggtgatggcacaaggaaagccgaaatctctgtccctcagatcgttgctgaagcacatgaaacctttcatcatccaaaaacttactgattttgcagagctggtattttacatgccggctctctttctttctgtctaaaaataggataaaattagtaggaattcaatcaggaggaacgagagatgagaaaaaaagagcgtcatcgtttgataacacgattgcttagtgagcaagatattcaaaaacaggaagaatttgtcgaattgcttcaggaaaaaggggtgtcggtcacacaagcgacaatttcccgcgatatcaaagaaatgaagctagtcaaagtcccttcacaaaaaggtggctaccgctacagcattcctcaagaaacgtcagaagatgtcattgccaaattagaaaagattttgaaagctgcctttgtttctgttgatcgaatggataaattcgttattttacgcacattgccgggaaatgcttccgctttggcaaatttgatcgataaacaatatgcaaaggaactgtttggtaccttaaatgatgatgacaatgtattgatgatcactaaaacagaagcagatgcagaaactttgtttaaagattttcaacgatttatgtagaggaggcaatccatgcttttagagttgaccattcaaaatttcgcaattatttcccacttacacctttcttttcatgaaggaatgacagctttgacaggtgaaacaggtgccgggaaatcaatcattattgatgcgatgggcttgttagccggcggacgcggatctactgactacttgcgtcaaggagcagagaaatgccgactggaaggcctttttgaatggccgcagcagtctgagtttcaagaactgacagaagaattaggcattgatcaagaagatgtgctgatcgtccaacgggatatcacacaagcaggaaaaacaatctgtcgtgtcaatggacgtacggtcaccttggcaaatctgcgaaagattggtctttttttagttgatattcaaggacaaaacgaacatcaagagttattacagccggaaaggcatcttagcttggtagatgggtttggcgatgatggtttcaaagaagaactgctgcactatcaggatgcctatcaggaataccgcaatttagaaaaacaggttcgcaatattcaggaaaatgaacaattatatgttcaacggatggatatgctgcgattccaacaagaagaaatcgcacaggctgaattaatcgagggcgaagaagaaaatctgatcgaagaacgtgagaagttaaccaactatcagaaaatcgtcgatgcactggggcaaagttatggtgcgctctcttcagaagaaatgagcagtgtcgacggtgtgagtgtggcactgtccgagatccaatctatcgcccacttagatcaagcctatgaaaaaatcactgaaacgatccagagcgcttattatttgttgcaggatgctgcttctgatatttcacgacaattagataaccttgaacttgatgaaggacgtctagaagaagttatcaaccgactggaaacgattcgtcaattgaagcgcaaatacggcgagtccatctccgtcatcctagcttattatgaagaaattagtaaggagatctctgaatctgcctatactgaaggccagctggaacagttagaagagcaattgacagctaaggccgatgctgtttgggctcttgctgaacaactccatgtcaagcggcgagaaatcgcacatcgattagaaaaagaaattgtgcaagaattgaacgacctctatatggaacatgcacagtttgaagttcgctttgcaaatggcaagcagttgacagctactggatttgatagtgtggctttttatctcacgaccaatcctggggaaggcatgaagccgttggttcgggtagcatctgggggtgagctgtctcgtatcttattagcattgaaatcgattttttcacggaaacaagggatcacgagtattgtttttgacgaagtagataccggagtcagtggccgcgtggcgcaagcaattgctgaaaagatctcaaaaattgcgttgaattcccaagtattgtgtatcactcatttgccgcaagtagccgcagtagctgattatcaatattttattgaaaaagcgatccaagaaggacggacggagactcgagttcgtcagttatcctatgaagaacgagtgactgagattgctcgtatgttatcaggagcagaaatcacagaactgacagtagagcatgcgcgtgaattgttagccttggctcatcagtaaatacttgaaagaagttacccacaaaatggaaacgcgaacgcaagtgccgctcccttcaaactagttaagaagcgactgcttggttcaggcggttccattttgttgattttggaggatggaaaatgaaaaaatatcaaaaaatactacttggtctagtgatcggcctactgctgatcggtgcaggtggatggttgggctggcaaaaattacactatccggcaagtgaagccgctcaagcagctctttcaaaagggcaagagaaacgagatgcgctttatttctctggagaccctgaaaaaccactcgttgttttttatccgggagcactagtagatgcagaaagttacagtatttgggcaaaagaggtgtctgaaaaaggatactcggttgcaatcgtcaagatgccctttgatatggcggtccttgggggaaatcgagcagagaatattttaaacgaatttccacatagtggctatgtgattggcgggcattcattgggtggcgtgattgcaagccgttatgccgctagtcaaaagaatgggttaaagggagtctttttcttagcgagttatccagatgaaaaaggcagtttagcagagactaatttgcctgtgctttctctcactgctagcaatgacgaggtattgaatcaagggaattatcaagcagcaaaaacctatttgccggattcagctattttcgaaacaatctcaggaggcaatcacgctggttttggtagttacggctcacagcgtggtgacggagctgcctcgatttcaaatgaggaacaacaacaacagatcgctgagaaactcacacaatggttagataacctggataaaacacaataatccgttattttggacaaaaaaagacggcagaagctggtacataaatgaccacttctgccgccgttttgattcaacatacatttggggaaatgttgatgaaatcacgaaaacgtcgaacataatttggggctattcttgattggggaagcaagaaaggttattatgttcttttaataattgttttcttatccagtatagcacagtaagaattgacaatatacttctttttactaattgaaaaaaatttttacttttttacttttagttattttctgtaagtgattgtaggaaatggagtaaatttttgtcaggagtgagaaatattagcaaataataattttcaacaattccataaaatggtaaaatggaaataattgtatttaactttggagagaacaaggagcgttatcatgaaaaaattgaaatttttgggaccagttttaggcttggtcattctattatcaggatgtgcaaaatggatcgatcaaggggaatcgatcaccgctgtcggctcatccgcattacagccgttagtagagactgtggcagaagaattccaaaatgaaaacccaggcagatttattaatgttcaaggtggcggtagtggtacaggattgagccaagttcaagcaggtgctgtagatatcggcaactcagatctgtttgcagaagaaaagtctggtatcgatgctaaagcacttgtggatcataaagtagctgtagtaggaatcactcctattgtaaataaaaatgtcggtgtatctgatatctctacagaaaatttacgaaagatttttctaggcgaaattaccaactggaaagaagtaggggggaatgatcaaaaaatcgttctattgaaccgtgcggcaggaagcggaacaagaggaaccttcgaaaaatggatcatggatggagaaacagcaatcccatcgcaagaacaagattcaagtggaatggtccgttcgattgtttcggatacgccgggagctatcagttacgttgcattctcttatgtgacggatgatgtcaatgttctttctattgatggcgtagcaccgacagacgaaaatgtgacgacaaatgactggaaagtctgggcgtatgaacacatgtatacgaagggagaacctacagcactgacagcagaattcctagagtatatcctttcggatgaagttcaagagcacattgttggggatcttggttatattcctatttcaagaatgcaagttgaacgtgattgggaaggaaatgtcatcaagtaacctttacacaaaatttacaatgttgccgaaaaatttacaaaaggtttaacagaaattgatgttcgagcgataaactaatatttgtgaatttagtttgatttttgaggaggaatccctcgtggaaaatgtaaaagaagtgttaacgaaaaaatctaagcgagcaaaaatggagcagcggggaaagctcattagttttctttgtatcgcattgatcgttttggttgtgatctcaattttttattttgtagcaagtcgtgggcttgccacgtttttcgttgataaagtaaatgtgtttgatttcttgtttggtacacaatggaaccctagtgctgttggtccagatggacagccgcttgtcggcgcattgccgatgatcgtcggctcatttgtggtaactttcttatcagcgattatcgcaacaccatttgcgattggtgcagctgtctttatggtagaagtttcccctcgcaacggtgaaaagattttgcagccagttatcgagttactagtggggatcccatccgttgtttacggatttatcggactatccgtgattgttccagcggtccgttctgtttttggcggtactggttttgggattctggcagggacatttgttctgtttatcatgatcttgccaactgtgacgacaatgactgtcgatgcgttgcgagcagtcccaagacactatcgcgaagcctcacttgctcttggagcaacaagatggcaaacgatttacaaagttgttttgcgggcagcagttccagggattttaacagcagtcgtctttggaatggctcgggcatttggtgaagcattggccatccaaatggtgatcgggaatgcggcattgatgccgtctagcttggtgacacctgcttcaacattgacatcgattctaacgatgggaatcggaaatacgatcatggggactgttgaaaataacgtgctatggtcattagcgctgatcttattattaatgtctttattgttcaatattgtgattcgattgattggtaagaaaggagcgttgaaataatgaatgcaaaacgctcagataaaattgcgactggtgtgctttatgctgtagcaggaatcattgttttgattttggcttctttattgctttatatcttagtacgagggattcctcatatcagttgggaatttttgacctcaccttccaaagcttatcaagaaggtggtgggattgggattcagctattcaactcattgtatcttttattggttacaatgatcattagtttcccgatttcattaggtgccgggatctatttatccgaatatgcgaaaaagaattggtttacagatgtagtgagaacatcgattgagattcttagttcgttgccttcagttgtagtcggtctttttggttttttactcttcgttatccaattcggttacggattctcgattatttcaggagccctagcactaacgtttttcaatttaccattactaacaagaaatgtagaagaatcattgcaagccatccactatacacagcgtgaagctgggttgtcgcttggattgtcacgctgggaaacagtcatgcgaatcatcgttcctgaagcaacaccagggatattgactggtgtgatcctaagttcaggacgtattttcggggaagccgcagcattgatttacaccgcaggtcagagtgcgccagcgttagacttttcaaattggaacccgctgagtgtttccagcccgatcagcattttccgacaagcggaaacattggctgtccatatttggaaaatcaatacagaaggaacgatgcctgatggaatccaagtttcagctggcgcttcagctgtcctgatcatcgctgttctattgtttaactttggcgctcgtgcaatcggtaaacgattgtataagaaaatgacgtcagcataaggagaatcactgtatgaatgattataattgggaagaacgcaatatcattacctttgatcgaccagaagacgtcgctctttatacaaatgatctgcacgtatggtatggaacgaatgaagcgatcaaaggaatcgatctgcaatttgaaaaaaacaaaattaccgcattgattggaccttctggttgtgggaaatcgacctatcttcgttcattgaatcgcatgaacgatggtattgcgaatacgaaagtaacgggtcaaattatgtacaagggtgtcgatgtcaatacgaaagaagtcgatgtctatgaaatgcgcaaacggattggcatggtttttcaacgtccaaatcctttcagtaaatcaatttatgacaatatcgcatttgctttgcgtcgtcatggtgaaaagaacaagaagaaattagacgagatcgttgaaacaagtttgaaacaagccgctctgtgggatcaagtcaaagacagcctggataaaagtgctttagcattgtccggggggcaacaacaacgtctgtgtattgctcgtgccatcgctatgaagccggatattttacttttggatgaaccagcgagtgcgctagatccaatctctaccggaacggttgaagaaacattggtcaacttaaagcaagattattcgattattatcgtgacgcacaacatgcagcaagctgcacggatcagtgactataccgcgttcttttacttgggaaatgcaattgaatatgatcacacacgaaaaatattcacgcgtcctaaaatccaagcaacagaagattatgtatcaggtcactttggctaatctgatccgatcagtaaacggaggctaagaaatggcagaagaaattatcacatcaaaagatctgcatttatattatggaaaaaaagaagcactaaaaggaatcgatctttccatcaataaaggagaaattactgcaatgatcggtccttccggctgcggcaagtcgacttatcttcgttcgttgaatcggatgaatgatttgattcctggtgtcacgatcacagggagtgtcgtatataaaggaaaagacatctacagtccgcaacaagatacagtagatttacggaaagaaatcggtatggttttccaacaaccgaatccatttcccttttcgatttacgaaaacgttatttatgggttaaaattaaagggtgtcaaagacaaagagattctcgataaaaccgtggaagaaagcttgaaagctgcctcagtatgggatgatgtcaaagataagcttcatcaaagtgcgctttctttgtctggcggccagcaacagcgggtttgtattgcccgagtattggctgtcgatccggaaatcattttattagatgaaccaaccagtgcgttggatcctatttcatcaggtaaaatcgaaaatacccttttgacactaaaagaacgatacacaatgatcattgtgactcataacatgtctcaagcttcaagaatctctgacaaaacagccttcttcttagatggcaacttgatcgaattcaatgataccaagaaagtattcttgagtccgagggagaaagaaacagaagactatatttcaggaagatttggttaggaggaaaaagcaatgttgcgtacacaatttgaagaagaattactgaatcttcacaatcaattttatgaaatggggatgcttgtaagtagtgcgatccataaatctgttcgtgcttatgtgaagcatgataaagagatcgctcaagaagtaatagaaaacgatgaagcaatcaacaatatggaagttcgacttgagaagaaaagtttcgaaatgattgccttgcaacaacctgtaacgactgatttgcgaatgatcatcactgtgatgaaagctagttccgatttggaacgaatgggagatcacgcggtatctatcgcaaagtcaacgattcgtgttaaaggcgagacccgaattgcagagattgagaaagaaatttccgatatgtctgactatgtcaaaaaaatggtggacaatgttttggtcgcttatgtaaaaacggaccaagaagatgcccggatgattgcacaaatggatgagcgggtaaatgattactatcgagatatctattataaaacgatcgatagcatgaaagccaatcctgagacagttgtcagtggtacggattatctttctgtggcccaatatctcgagcggattggtgattatgtcacaaatatttgcgaatggatcgtttatttggctactggtaagatcagtgagttaaatagtaatcgttctgagctgatgtagtgagcatatctttgttcaaaatatagatttagctcatcagctttcacatgaatgtatattattattgtacggactgtactgtaagaagagagatgaaaaatagcgtatcattgatctgggatcatggataaactattggaaaacgtgtgaggttattcttgcgctattcggttcttctgtagtacagtttttttgtagttttttagataaagctgataagcacaagttttcctttcacaaagaatcatcttctctgatttcaagcagaacaattactcttttattgaaagaacttcggattgataaaaacttggtacttaagacctatgacagtttgcggaaaaacaggcataataggttcgtaagctaaacttgcaaacaaaaatttgctgaaggaggcaatttccatgaacgaaagagaacgtgtattggatttagtgaaaaaaggtgtgctttctacagaagaagcattggatttgctggaaggaatggcaaaagccaaagacgagaatcaaatcaacaaagctgcagctgaagtatccgctgataagacaaataatgacttttttgaagaagttgaagaagcccacgagaaagaagaagcttcttttgatggtgaagaaaaacttcgtcaaaatgaagcacaagataaagaaaatcttgaaaaaatcttggacggattggcaactgaggcaaaccaagcttctgctgaattagatgagatcaatgtagaaattcaaggtgtaaaagaggaactgaaagaagcacaagaagtcctcatgcaattgaacacaaaagaggaattggatcaattatctgaagaagaacttgcaacacggcaagagacggaagcgacaatcgcttctctagaagattcattagatagtttgagcgaagaaaaagcgacattggatgcgaagttgaaaaatattcgcaaagaccaatggtcacaaacaaaagaaaaaatcagccaaaaacttgatattccagatgactggaaagaacaagcctctgatacatttactcaagtcagtgaaaaaatggttgatgcaggtactcaatttggacaattcttgaaaaaaacagttcgtgctgtttcagaatcagtgaatgacaacatggaatggaaagatatcaatctgaaagttccaggagtagcagcaacgaaatttgaacatacctttgaatatgctgaaacagaagcaacattgatcgatgtgaaactagcaaacggaaatgttgaattccgcttgtgggatcaaccgggtgtgaaagtggatgctaaaatcaaactctatggtaaaatggatgctgcaacacctttcgatgcttttgatgcacgaagccaaattgatgtcgacgatgaacgcatttcattccaaattccaaacaagcgtatccgcgctgatctggttttctatctgccgacacgtacctatgatcatgttgcagtgaaattgttgaacgggaatgtaacatttgacgaattggtggcaagagatgtttatacgaaatcaaccaacggtacgatcgatttccgcaaagtagatgctacgatgttggagattgaaggtgtcaatggaaatatcttggttcaagatggagatatccttgatgctatcattgaaactgtcaatggggatgttactcttaccgcgacaccacaaaatactggaatttctctagtgaacggtaatatccgaatcacttacaaagaagaccgactacaaaaattaaatgctagctcagtcaacggaaatgtcaaagtagcattaccacaatcagttggatttgaaggcttggcaaaaaccagcttaggaagtatcaatcaacggctgagcaattttgaaatcgtgcgtgagaaaaaagaacgtatgaaccaattattgcaattccgccgcgtagctgataaagtagcacaagtcgatctttcaacaacgactgggaatgtctttatcaaagacacagaacaataatctgattccatcagatctatagatagattgtcagaaggaaggtgaaggtaaatgaacaaacgattaacgaaatcaaccaataatgtagtgattacaggtactctgggaggtttagcagaatacttaggaatcgatccaacgatcatccgtgtgatctatgtctttctatcattagtgacagctggtttccctgggatcaccctttatgtcatcatggcgatcttgatcccttctggacgcaaaagctctggtggatatggacacgacaatcagtactacaaagcgaacaacaaagaaacaaatcgtccgcgcaaagaagcagataaagtcgaggatgaggactggagtgacttctaatgtcctactttcaacgactgataatgaatacactcacctttgttgctctggcagtattgctgccaaacatggtccatgtacgtagcatcatgatggcattagtagccagctttgttctctctattttaaatgcgttgatcaaaccaatcttgagtatcatctcatttccattaacgctgttgacatttgggcttttcagttttgtcatcaatgctttaatgctgaatttgacttcaacttttgtaggagctgctaactttggcttttcctcatttggtgcagcgattctggttgctttgattatgtcagtgatcaatatgattgtgactgaacaccatatcgaaaaatatacaaaataaaacatccacacgtttctgatacatagctagctatgttgaaagaacgtgtggatgtttttgttgtttaatattaaagaacaatgtgaacaaacaaactgtaataataagaaaagcaaaacatctttttttgtaattttttataaaagaaagacaaatccgccaattatttcttcgaaataaccattttttgtcatgttcatctagctgtgtcatgttaaattgagtagaaaaatctgtgaaaatactcgtgtctattagtttcatttgttattgtttcgcagtgataaatattgatagaagtagtattttatgaaggggatcgatgggaatacgagcagtatcatcgcaccacttttttgactaatagctattcactaaattgaatagtctaagcagttaagccgcccacgctagagtaccattctaaaatctacggaaacaattcttgctgaatatccactactactaactaagtgaatagttatattgttcttaaatacagctgaatttttgcacaaaggttcttttaatgcgcttgaaagtgcaagcgggcatttttgattaataatacaattaaaaatgatgtaaaaaaggagaacttagatgtctgcaaatttaagcaactttgctgtttatgtagtagatgataatttttttaatggagagtggctaaaaaaagcgatccaagaatgccaacttccgtgtgcttcagtagaaattttcctgccggaccaatttgagcgttttattaatgaacaccttaccgatatcaatgatttattcttattttccactgatatgaaaggatatgatcgaggttttcaattagcaggaagattgagaagccaatgtaaaaaatgtcaaatagctttttatggaattgatgcttcaaagatacagatgaaaaaaatgaacctcctgtgcccattagggatcattgatacaaaagaagcgtttaaacaccaactaagaaacttattaattgaagcaatagaaataaagcaatcattattaggcaaaaagcacttattaaagcttgaaaacaaacgagaattgatcgttatggatgcagaatcaatcaactatatcacaacggtcaaagaagagcgcaaccaaatcgttcttcaccaaaagaagtcgatcgaatacattgagatgtccttgaaagtcatcaagcaattggacctacccgcttattataaagtgtttaaatcctacattatcaatacaggacaaatcaggaaaattgatcgaacaaacaacattctttctttttttagcggtgaagaattagaagtgggtaagaaaataagaaaagcgattgattaaaaatacatatataaattggaggagaataatgaagaaaatcactaaaaaaatagaacaaagtatggttgttattgcattgagtcttactcagatcacaacgccaatactggtgattgctgaaacatctgaggctgatcagccagctgaaacaactagtaaaatagacaaagaaaaagatcctatcttggcttcatctgaaaaagaagcttcctcattcacttcaagtgctagtagtcaagaagaagttgatacttcttccagtgaagagaacgaagtggatcaaagtgaggaaacatcaggtataaaagattctagtgttgcagaaactgaaaccaacaaatcttctactgatcccaaaatagttaagaaagaagaaaatgcttctcgttccaatcgacaaataaaggcgcaagaacttttaaagaaaggaacactgcttacgatggctgatgaagagtacagccaaacacaggaaacaagagtgctaaataatacaccagttaaactaaaattggattttgaaatcattgacgaagattacttagctggaacaactgttgtttttagtttgccggacacccttggatttaccgataatcaagggacgattcaaggcatcgatgcgacttggcaagtagacagtgccaatcgtcaagtaacgatcacttttaatcaagctatccacgatgcaacattttcccttgaattaaagagttatctttattcagaaagtaccccgcaaatcaaagtgacaattgatgatctaaataaaaccagttatgcgatcgatctttatgaagatgtcgaatcattgaagtacgagcaacaaaaaaacatttttggtctagatggtacagtgtattataatttagaccgcaagctctcgggaacggaaacactctctttgcaacttattgacaccccaggagcagttttcaaaaaaatagaatcgcaaccactaaaggtttatagctatgatgtagatatcaaagggaatatcacgccagaaacgcaaacggagctagccgctggcacagattatacaattacagctaatgacttacaaaatacagcagttgagatcaaacaaatggatcagcaaaaggcttatggtgttgtctatcaattcacgatgagcatatctgaaattagttaccatcagtattcttattacaaaaactatccaaccaccggttttggatcagtaaatcttgaaccatcggctggggagtaccgtggaatttcttttgtggcaaaaacaagtcaaactgaaaaagaaatttcatcaaggtattatacagctgttgccggtggaaatttatattccaatgaaaagggatcctactatttaacattacatggcatgccaactgaaatgaaaaaaggacagcagataacgatatccgctgaaaatggacaggaacttacagtgaagcaactaatggtcaatgatgctttttatcaaaatgtacctttagatgaatactttaaagtcgaaaattctaacggcatgttgaccttgacggcaaccaaagacagtaacctagcattttccatgattcatcttacggttccttttgatcaaaaagacatcgtcatgaatgtcacgactcctttgattcccaatgaaaaattcaaagtgattggggatgattatgtacaaccaatctcagttttatatcctaattcagctgagacagcttgggggaactacaaccaaaatggtgcctatgcaaatgatacttcagtcaacgttgaaggaagcacaacacaacctgtcgaaaatcttaaaatcttcgtcgaacatccagattatttgacacttagaaaagttccagaagtgaactattattacaagatcgatcaagattaccgtatcgagaaggttgagggagggtccttagttacttttattacgccaatcaatcgttcaattcaatttgacattggatttaattatgtgccagacagtctcgcttctacaacgcggatcccagtagataaaattccgattagtatctcagcggatggcttggatactgtcaatacaacagttaccactggaagaaaaaactattcagaacaaacgttgcaaggaagcaaaaatcaatttttagttaatgcccggcaagataccatcaaagatctgaaggtagaaacacatgtaccaatgaatacagatgtcgtattttccattatcgatgtctcaaatgatcaagtggaagggatttatcctcaatactgggctcgggggcaatacaatacgcaagtcatgaaagaatcagatccgaattaccctaccatcacgcatgatgaagcgacgaattattatacgttcgattttgggacaactgatcacagatacatcattgcctatcattatgcaaatggttggcaggaaacgaaatcaattctgataccgggatttgctaaagaaccactgtatggtaatcaacaagggtcatcgacggtcactgtctctaataccgcaacagacattatcgatattagtcaaaggacagttactagcgcaaaaaacgtaacccaagtcactgtgaaaacgaaaaacattgatgatggaacaaagaaagttgtaaatccaacgttcagcttaaaatctattggcaacaccaatggagaaatcgatccaaactccatcagaatctcaaatgttcctgatgatagttataaagtagagaaagttaatggtgagattcagctggtttttgcaaactatgtgcttaaggagaacgtggagatcagctataccgtcctttctcaaaacgctggtcaaatttctgcatcagccaccatttcatccgagacgattgatacattgtccgaagcaaagcgcaccgcgacatccactatcgcaaatctgcaattttcagcaggtgattcggaagggattatctataaaacgtctgctttacttgatgtctttgatacagaaaggccgacaaaaaagattgctggagtttcattaatgttaatcaatcagttgactggaactgtgatcaacaccaccactgatcaagtaggcgagtcacagttgacagatatttatacaggtaaatacaaggtatacgtttcaaaagttcctgaaggatatgttgttccagaagatattcaatctggtatggatgtaaaagtcaatcgaacgggtaaccagatatctattggaatcacaccagaaaaagatttatccagtatttcagtaaaagacagcacattatacgtaggagacacatggcaagccgaggacaactttgtctctgcgacggacaaacaaggcaataacgtaacattttcaaaagtaaccattagcggcgatgttgatacatcaaaagtaggtagttatcaagtgacttataccaatggaacagctaaggcagtggcaacgatcaccgtcgtgtctgatcaagcaaccgtggtagccaaagatagtacgctctatgtgggagattcttggcaggcggaagacaattttgtatccgtcacagataaagacggaaaagcagtatcactcgctaatgtaaccgtcacaggtacggtagacactacgacacccggaaaatatgaagtcagctaccgcaatggtaaagttgaagcaatagctacgatcacagttttagcagatcaaacaagcgtcaaagcaaaagacagcacattatacgtaggagacacatggcaagctgaggacaactttgtttctgcgacggacaaacaaggcaataacgtaacattttcagaagtaactgttagcggcgatgttgatacttcaaaagcaggtagttatcaagtgacctacaaaaatggaaacgccgagtcagtggcaacgatcaccgtcgtgtctgatcaagcaaccgtggtagccaaagatagtacgctctacgtaggagacacatggcaggcagaagataactttgtctctgcgacggataaagagggaaaaacgttgtcagtagctgaattggatataacaggggatgtcgatactacgacacctggcaaatatgaaatcagctaccgcaatggtaaagttgaagcaatagctacgatcacagttttagcagatcaaacaagcgtagttgttaaggactcagtagtgtatgtaggcgatcaatgggaggctaagaacaattttgtctcagcaactgatcgtgagggcaataccctatcaattgaacgacttcttattgaaggatctgttgataccaggaaggtcggtacttatcaggtgaactattctgttgtttcaaatgagaaagtagcaaatccagcgctgtttgagcgcatatttgggacaaccaaacaattgactgttacggcaacggctacgattcaagtgatcgaaaaacaaccagcaaccgacgatggaaaaaaatctaacaacaatgatcaaactaaaccagttgatccaaagtcaaatgatggaagtaaactgatcaaagcaactgctaaagatcgtcaacagcgagttttgccaaaaactggttcgagtgacaatcaagtttatccattagtggggattgcattcattgggcttgttgttaccttcttctttagaagaaagaaaaaagcgaacgaataagcttataaaattggctcaatagccaagcaagaaagcagcgagtattcgttgcttttttgttggtccttagtaagttagtcctagcagctggcaaaaaaagagctgactattcttttaacgtacctggttgactagttcgtgactgcatgtcgtttatttaaaggactgcaatgaaaaatggaacgaacaaatcaatgatgattcgttcgttccgtggattgtgtggtctattttagttgttcttcggaaacattctctaggtaatcatcaacagccttcagagtatcatctaacgcacctttttcaaagggcgaacgtaagtgagctgtttcgagaatttcaagaaatgtttgtgtaccgccgacttgacaaatggccaaataatcttgccaagcagtaggatcttgggctacgatcgaacgataccaaaattgaaaggcacaaacttgagctaacgtatagtcgatataataaaaaggtgactcaaaaatatgtccttgtctaaaccagtaaagcccgcgatccaaatcaggaaattcactgtagtcacgttctggacaatagcggcgttccaggtctctccaacaagtttttcgttgctctggagtccaatcaggattttcgtagacttcttgttggaagtgatcaactaacacgccgtaaggtagaaatagtagacagctagccagatgggcgaacttgtactttgcagtttcctcttcaaaaaaagcatccatccaaggccaagcgataaattccattgacatggaatgaatctcacaagactcgaaatttggaaaaagaatttctggctctttgatccaacgagactgaaacgcttgaaatgcatgaccagcttcatgagtcaagacatctacatcagcagcagtcccgttgaaattcgcaaaaataaaaggagattgatattcctggataaaggtacagtaacccccagattgcttgccttttttgcttaaaagatccaagagctcatgatcaaccatgaagtcaaagaattcacctgtttcttgagacagttcatgatacatggtacgggctttctccactaattcgtttgcggtgcctttcggtgttgcatttccgttcggatagaccaatggcaaatccgcaaaagtggcttttgatagctgattacgttttgcttggcgggcatacagcttttgagtgattgggacaactttttctaaaatttcctttcgataggtttcgatcattttgcgatcataatcccagcggttcatttggacatctgcaaaagcaacataattttcgaagcctaatttatgggcgatttctgtacgcactttgatcaattcatcataaattgtgtcgaatttcgtttcattttcagcaaaaaatgctgtttgaatgtttattgcttccaaacgaatttcacgatttttgtgttcagtaaaagggcgtagttgtgcaagggtatagctgtctccttggaactccagctgggcggaagcaatcaatttgccataatcagaagtcagttgattctctttttggaataattcgatcagtgattcatcaaataacttcacgcgactttcagcaaataaaaagaacgtttctggatagatagtttttaattcttccactagcggtgaagcgagtagacaacggtagaaacgaaaatccagtgattcaaaatgaggctggtactcattccaaaatgtatcttctgcttcataatacggatccgtcgtatcaattgagtgtcgaatagaagccaagttgactgccgtgtcgatcgttccccgcaaataatttaattcatcgatggctgtttttgcagattcaaggttggctgcttcctcaaggttgtgtaacgcttccaaataattgtgtttgtaagaatcaaaatctggtcgtacgtaagtatagtctgaaaatttcaattaaatccctcctctttaaaaataatagcataaaataaaaagaaataggtagttccaataacacgtgtagtaagttttaagatagaatgataaaatagagaggaacagtttgcgaaaaagaagcagctgaagaatcaatggagatgaagagagggactattatgacagaaaccgtcaaggtcaatgagttggctgaggctttgaacttagagatcgtccaaggggatgaaacaagtttggaacggacaatcatcaccggggatatttcgcgaccggggttggaattgaccggctatttcaattattattcccatgatcgattacaactatttggaagtaaagaaattacttttgctgaacgaatgatgccggaagagcggttgatggtcttgcgtaaaatgtgttcagaagatacacctggattcattgtttccagaggattggctatcccagaggaaatgatccaagcttgtgcagagcacaatatcgcaattttgcgttcgcctatttcaacttcacgattgctaggtgaactttcgagctatttagatggacgattagcagctcgaacaagcgtacatggagttttggtagatgtttatggattaggtgtcttgattcaaggagatagtggcatcgggaaaagcgagacggcattagagttgatcaagcgtggacaccggctgattgctgatgatcgagtagatgtttataagcaagatgaactgacactggtgggagaaccgcccaaaatcctccaacatctaattgaaattcgcggaatcggaattatcgacgtcatgaacttatttggtgccagtgcagtcagaggctatatgcaagtgcagttggcagtttaccttgaagcgtgggctaaagataaaaaatatgatcgcttaggtacggatgatacaactgttcagattggtgaagtagatatcccgcaaatcaagattccagtaaaaaccggacgaaatgtcgccatcattattgaagttgcagccatgaatttccgggcaaaaacaatgggttatgatgcgacacaaacgtttgagaatcgattgacacagttgatcgaagaaaattctggaaattagagaggaacagtttatatgttagctttagtaaatcgtgttgcttttgagttgttcggtctgccgatctattggtatgcgatcattattgtctccggtgtcatcattgcgatgtggttgagtacgagagaagcagtccgtgtgggattgaaggccgatgatgtaacggactttatgttgattggcttgccagtttcaattatcgggggcagactgtattacgtcctatttgatttagaaccttatttgaaagatccaattcaaattttcaatactcgttctgggggattggcaatctatggggctttgatcgctggaggaatatggctgtatttcttttgccgacgcaattttatttcaccagtgacctttttggatattgcagcacctagcgtgttgttggcacaaggaattggacgttgggggaatttcatgaatcatgaagctcacggcgcagaagtcagccgttcctttctagaaagtctccatctacctaattttattattgataatatgaatatcgatggagcttatcgacaaccaacattcttatacgaatctgtctggaatgttttaggttttattgttttgatcttactccgtaagaaaaagggacttttaaaagaaggcgaagtcttcctagggtatctgatctggtacggttttggacgcttcttcattgaaggaatgagaacggatagtttgtacttgtttggaccgatccgagtatcgcaagtcttatcagctgtgttattctttggtgcaatcatcgtcttgatctggcgccgtaaaaaaacaaaagtaaaagattacaaccgttcctatggagaaaatgaatatgtaatctagcagttatttttcggcaactatggtaaaatgattgagtgaagttttattgtaaatgaacagaggaggtttccatcgtgaaacaaaaaatagccgtattaggccctggctcttgggggactgcgcttgcacaagtgttatccgagaatggtcatgaagtgaaaatttggggcaacaatccagctcaaatcgatgaaatcaatacgtaccatacgaatcgtcattatctgccggatttgaagctaccagaaaatattttaggtgttaaggctcttgaagaagcgatcattgatgctgatgccattcttttcgttgtaccgacgaaagcaattcgggcggtcgctaaagagtttgccgaaaaggcaaccaatcgtcccgtgatcatccatgcatcgaaaggattagagcaaggaagtcacaagagaatatctgaaattttggcagaagagattcctacagagaaacgacaagatattgttgtgctatccgggccttctcatgcagaagaggtggctgtccatgatattactaccattactgcagcgagtgaaaatgaagaatcagcaaaatatgtgcaggaattgttcatgaatgactatttccgtatttatacgaacaatgatgtaattggggttgagactggtgcagcattaaaaaatatcatcgcaatcggtgcgggagcaattgctggtttaggctttggagacgacgcaaaagcggcgatcatgacccgcgggttagctgaaatcagccgactaggagtagctatgggagccaatccattgacctttatcggtttgagtggtgttggtgatttgattgtgacttgtacgagtgttcattcacgaaattggcgtgcgggaaacttacttggtaaaggacacagtttggatgaagtattagaaaacatgggaatgatcgttgaaggtgtatcgacgacaaaagcagcgcgagaactggcagcagctttaggtgttgaaatgccgatcaccgaaaccatttattctgttctttatgaaggaaaagcaatcgaacaagcagccaaagaaatcatgctgagagatggcaaagaagagaacgagtttacgcttgaaaagtaacgataaggagagagacaaatgaatgtaaaaaaagcagttattccagcagcaggattaggaacccgttttttaccggcaacaaaagcaatggctaaggaaatgttgccgatcgttgataaaccaacgatccaatttattgttgaagaagctttacaatcagggatcgaagatattttgatcgttaccggaaaagcaaaacgcccaattgaagaccatttcgatgcaaacttagaactagaaatgaatctgcaagaaaaaggcaaaactgaattattgaaattggtcgaagaaaccacagatgttaatcttcacttcattcgtcaatcacatcctaaagggttagggcatgctgtcctacaagcaagagcctttgtaggaaatgagcccttcgtggtaatgcttggcgacgacttgatggaagatgaagtcccattaacgaagcaattgatcgatgattacgaaacaacgcatgcttcaacgattgctgtgatggatgttccgcatgaagacacatcaaaatatgggattattgatcctggcatgcaagttgataaaggattatacaacgtgaagaactttgtggagaaacctgctccagacaaagcgcctagtgatttggcaattattggccgctatttgttgaccccagaaatttttgatatcttagctaatcaaaaaccaggtgccggcaatgagattcagttgactgatgctattgatacgttgaataaaacacaacgcgtatttgctcgccaatttactggtaaacggtatgatgttggtgataaatttggtttcttgaagacaagcattgaatatggcttgaaacacccagaagtcaaagacagtctaaaagaatacttgattgaattgagtaaagaattaacaccaactgaaaaaacagcaacccagccaaaaccaacaaaagagaacaagtaagaagaacgcttgccgaacaactgacgatcaatcaaagttgttcggcatttttttggttttgtatgaaagcggatagattttagtaaaaaaaacaaaattcgttagtcttttatttgtagaacgccgtttgaaatgctattcttaatataagtaaaaggggaaggagacattttatgacaggaggagagattgcagcattgatcgctgcgattgcattcgtcgtacttgtcgtttttgttgtacgattattgatgcaagtaagcaaaacgatgaccaaagtggataaaacagtggaagaagccaataccacgattcgagtcatcacccaagacgtagatatcctttcaaaagaagtggagggattgttggttaagaccaatgaattgctgcaggatgtaaatggcaaagttgcgaccattgatccgctctttactgcagtagcagatttaagtaccagcgtctctgaattgaatagttcaggaaagaacttggtctcgcgagttggcagtttaggtcgaacaacggctaaagcaactgttgctggtaaagtaggtcaaacagcaatgaaatttttcaaagaccgtaacaaacaacaataagaggaggaatttcaatgagtaaaaaaggtggatttctattaggtgcagtaattggtgggacagcagcagcggtagcagccctgttattagcacccgagtcaggtaaaaacttgcgaaacaaactagccaaacaagccgatgatttattggataaagcttctgattatggtgatatggctaaagataaaagtaccgatttagtggagatcgctaaagataaagcagctaaacttggcgaacaagcttcaggttttactgattcattgactgcaaaagtagatgacttaaaagataatgtagctagttcttctagcgatacagttgaagaattaaaaaaacaggcaggagatttatctgagcgcttcaaaaaatctgctgacgaagtcaaaaattctgctagtgatcttcatgaagacgtccaagaaacagcagaagacatttttattgatgcaaaatcttccgctgcagacatgaaggaaacggtaaaagaaggggcagaagaggccaaaccaatcgtagatgatgctgcaaaagaaacaaaatcagcagcaaacgaattgaaacatgaagcaaataaaaaagcggctgatgtaaaagcaacaacaaaatcagaagccaaagatgcgaaagaagattttgaagaagtcaaagaagaattaaaagataaaatggaaaaaaataatccagaagcataatctttctcttttgaaagttaaaggagctgcttttaatcggtagcaaaaaaacatccaaacgaagataaaatgccgagccgtgacaacacggttcctgcgatcaaacagatcacagacgcatttatttctagtttggatgtgttttttttagcgaaggcgcacatagttaagcgtttttgatctcttgatcacatagtgagtagatccaatcagatagttgggagaattgaaagccatttgcttcagctagtgctacatttatcgaatattcaggcgtgccattgtattttccggcttctccggtaggtgataaaagtgggtcaatgccagttttttttgagacataagctaaaatttctgccagtgagagggtacctttagcagcagcgttgacggggcctgtaaaggaactggttcctaaaaatgctaaaaattttcctgcttctttagaatcgataaaactcatttgatgggaaagattgtcaataaacatggcttttttttgacaaacggattgaatatagaaagacaaccgtttggtatagtcatcaattcccaccacataaggaaagcggacaaatgccgaattttgtgagtatttttggcttaaaatctcctcgacactgcgttttccttctgcatagttcacttgttctgaggtcacaagacgataagcatgtgctgttggatcaaaatctttttcgaccagattgtcatggaaagttggataaacagacatagagcttgtgacaatatagcgttcggtagtgacatgacgcatcaaaatatcaatatcattggaggtataggcgatattatcgtaaatcacatcataagtttcttttgtcaaaacagatcggatactgtcttcatcttctctgtcaaaaatcaatcgagttacctttggaccaaatgagtctggtgtttttccacgagtagcaatcgttacgttcgcaccctgtgtaagcagttcattgacgagatgtttgccaaaaaagcgtgtcccacctaaaaccaatacattttgcgtcataatccatctccttttttaattcaatactagtagctcttttgcagtttttgtaaacggcacacaaccagtttcagtaacatagatacaatcttcgatacgaacaccgacttgttcaggaatgtaaatcccaggttcgatggagaaacacatgccttcttcaatcaccaaatcattcccggtaatcaatgatggaaattcatgaaccgttgtgccgatcccgtgacccaatcgatgattgaagtattcaccgtatccatgactttcgatgaccccacgagcaatttcgtccagttgacccgcagtaatgcctggtctaacagctgcttgggcagtcagttccgcttcaaggacgatatcatagatatttcgttgcaattcagtcggctcgtgataggcaatggtacgcgttgcgtcgctgcaatagccattccagatcacacctaggtcgaagagaactagttcatttggtttgatttgttgtttacctggaaccccatgagggcttgcagcattggcacctgctaagaccgtcgtatcaaaggacatgtgggaaacgccgcgttttttgagttgatattcaatctctgcaacgatctccatttcagaaataccttctttgacagcagaaaaaccaatctcaaaagcgacgtctgcccaattacctgcttcaagcaatgtgtcgatttccgctgctgttttggttaattgcattttctggatcacaggagtgatatcaagtgaaaaatcagttcctggaaggaaaccattcaatgcttcgaaacgttcaacagtcaaatcattcttttctagtgctaatcgtttgaggtgataacgagattctagctctgaacagatttttttccaaggatcttcactatctaaataaccaatcacatcgtagggccagccactatttttagcttcttcaacttctaaagctggtgtaaataggaaagggtctttatcaggtgaaagaaagagtgctaatacgcgttcatgaggttcactcttgaaacctgaaaaataggcaatcgttgaaggatttgagatataagcgacctcagcttgattgctggctaaccacgttgtcatttcttgtattttttctttattcatgaaaaaaccttctttcaagtattctttctccattttagcacgctttactggagaatgcttgtccgtaaatatgtaaaattgactaagttttcatgaaagcggaattaaaacggttgcatattcgcaaaaagtttgctattctatcaaagaaatgtaaataagattttctgaaaacagaataaagggagatatatcatggaaaaacaaacaattacgatttatgatgttgctcgtgaggcaaatgtttcgatggcgacggtttctcgtgtcgtgaacggcaatccaaatgttaagccagcgacacgtaagaaggttctggaagtcattgaccgcttagattatcgtccaaatgctgttgcacgaggattggctagcaaaaaaacaactacagtcggtgtaatcattcccgatgtcagcaatatgttcttttcttcattggctcgtgggatcgatgacgtagcaacgatgtacaaatacaacattatcttggcgaattccgatggcgatagtatgaaggaagtaaacgtactgaacaatcttttggcaaaacaagtagacggtgtgattttcatgggtcatcggatcactgatgaaatccgtggcgaattttcgcgttcaaaaacaccagtggtacttgctggctcaatcgatcccgatgaacaagtggggagcgtgaacattgattatacagcagctacgaaagatgcagtaagtttactagccaaaaacaatcaaaagatcgcttttgtcagcggtgcattgattgatccaatcaacggtcaaaaccggttgaaagggtataaagaagcgttaaaagaaaacaacttagactattcagaaggcttgatttttgaagcgccttatagctttaaagaaggcttggcattagttgaacgaatcatgaacagtggagcgacagcggcatatgtaacagacgatgaacttgctatcggtgttctagacggtttgattgaccgaggtgtcaaagtacctgaagaatttgaaatcattacagccaacaattctttattggcagaagctgcccgtccacgtttatctagcgtgacacagcctttatatgacatgggtgctgtagcgatgcgtttactaacgaaaatgatgaacaaagaagaagtagaacaaaaaacaattgttttaccatatggtatctctgaaaagagttcaacgaaataagtgagaaaaaagaagaaaccgttcttaggagcggtttttttatttacatatagatataaaaaagaacaggagcaacgatgtgcttcccgttcttcaggtaaaacagattttggcaaatgactgtgatgacgtaatcagtcatcctctttctgctcgtttttcttttcttccgttttttctgcttctttttgattattgttattgttcgtggcgttttcttctttattggtacttctagagccattgttcgtggctgtattggtagaagtagatgttgttgttcggctaggggcgattttcttccaataatctgcataattggcattcgatccgccaatcccaaattcaaaggatgcttctttgggaccgccttttgtccaatacgaagtaactgtgtcgcttggattggttcttcttgtgttatctactgtgaccgtgccgcctggaagtgttcctgtagccttagacactttgatctttttgacatcatcggataactcgaattttttatccactccaaagaccttctggtcggattgataaatgcgattgatcaaataagccatgtattgagcggtacgtgttccggcactactatcggtggctttgttgtcatcacgaccagaccagctactgatggtaatggaaggagttgagaccacgagccaagaatcggaccaattgtttgtcgaacctgttttaccgacccaatcggcatttccaaggttccaatccagaccactaacaacggatttaaagttagacgtcttttgttcgtcaattacactgcgcatcatgtcattcatgattgatgctgttgcttcagagaagacttgaactggtttttgttcatgctgatacaagacttcgccttcattgttcttgatcgattcgatcacataaccttcctggtaaacgcctttgtttgctaacgtttggaatccattggtctgagttaaaacagttacgttggtgactcctaaaggagcagactcataagcccaactattgtcttcaggatagttcatcttgctcaaataattcttataagagaagaatgggtcaccttcttgctcccaaatgtcttgaaaaatgtttgtcgcagcgatattactagagacttctaatgattctcgaatcgacataaaggtattggttcccttatttgtcgcgttaacgattggttcatccgcattttcaccagtgcgccatttagctgcgtaatcagagaccattgattcagaacccatcaagccttcatcgatggcaggaccgtaaacgagcattggcttaatacttgatccagcttgtctttgggcatcgaacgcatgattgaattgattttgctgataatcgcgaccaccaatgaacccaagcacacggcctgttgcattatccatcatgacattcccaacttcaatgggcgcatcgccccagttatccagcatatagccatatttggacacagcgtcttgcatggcattatagatgtttttatcaatggtagaggtaactgtgtaaccaccattgactaatttttgttgtgctaattctaaatatttctgataggtttcttctttactgtattcttctgcgctaactttatcttcgtccgccaattgtttagcgatgatatctttggcttcattgagaaccgtataatagaggaaactctgatcggtctgctcaatggcttcttgttttttgaagtcttgtttcaaatcataagccattgcttcgtcgtattctttttttgagatgtcatgattacgatacatactaaagaggacgaagtcttttcgatctaaaccggcactgagattttctttgatttcaccagtattcgtgtacggactatagacgatcgggctttgtggcaatccagcaataaaagcagcttggggaagtgtaagatcggcagcattgacgccaaatattccttgggccgcttcttgcacgccggcaatattttgccctttattatttctaccaaatggtgaaatatttaagtacattgtgactatctcatctttagagaaaaacttttcgacttccatcgccaagagaatctcattggctttgcgtttaaaagtagtttcgcttgagagaatttgctgtttgactaattgctgagttaatgtcgatccaccgccaccaccaaagccagttgcttcagagaggagggcacggacgaccgctttaggaacgacgccattatgctgattgaaatattcgtcttctgttgcaatgatcgcttttttgagataatcagaaattttatctgaagaaaccgatgtacgcatcagatctgatcgaatcgtggcgattttactaccatccgcataagctagctgtgaagtctctgtgatgtcggttaattcttgctgcagttcttcttttgacggggcagcggtatcttctactaaaaatgcaaaatagccaacaccgatacctagtgcgagtgaaccgcccagaatcgaaaaggaaattgcgactaaaaagagcgaatggagcacgcgcaagctgatattgaaataaaaccagctctttttcgtacttggagattttggttgttttttcttattttggggcaaaaatggtcacctcaatgatattagaatagattccgttgtattatagcaaaaatcaacgcacttggatagttttgctcgttatcacaatcaaattataacaaatacgggattgatccaaaatgggattaaggcttttctttaggcggattttcagttaatatgaacagtgagtaatgatttaggaggaaaaaaaatgagttcagacttttttgaagaattaaaaagtcgtggtctggttcatcagactactgacgaaagtgcattgatcaaacaattaaacgaagagtctgtgaaactatatattgggtttgatccaaccgctgatagtttgcacattggccatcttttaccgatcttgatgctgcgccgtttccaacaacgaggacatgttcctattgcattagtaggcggaggaacagggatgattggggatccatctttcaaggaccaagaacggcaattaaatacattagataccgtcaaggaatggtctcaaagtatcaaaaatcaattgtctcgttttattgactttgaggatcaaacgaatccagcaattttagccaataattatgattggttaggcgaattaaaattgatcgatttcctacgtgatgtagggaagaactttaccatcaactacatgatgagcaaagaaagcgtaaaacgccgcattgaaacgggaatttcttataccgaatttgcttaccaattgctgcaagcctatgacttcctaaatctttatgatgaacatggctgtctattgcaacttggaggcagtgaccagtggggaaatatcacgtcaggaattgaactgctacgtcgcgaacgagaagtccaagggtttggtttgacgatgcctttgattactaaggcagatggtaccaagtttggtaaaactgaggggaatgcagtttggctagatgccgacaaaacaacaccttacgaattttatcagttttggatcaatacggatgaccgtgacgctgtgaaattcttgaaatacttcactttcttatcacttgaagaaattgcagcaattgaaaaagaattcttagctgcaccagaaacacgagttgcccaaaaagcgttggccaaagaagtgaccacattagttcatggtgcaaaagcatatgagcaagctgttcatatttctgaaagcttgttcaatggggatatcaaaggactgtctgctgacgaaattgcacaaggattcaaaggggtcccaacctatcaagtctcgaatgatgatgagttaaacattgtagaattgttgactacttcgaaaatcgaagcatcgaaacgacaagcccgggaagatatccaaaacggggcaatctatgtgaatggcgaacgccaacaagacttaaattacgtgatcaacgaagaagaccgtatcggcggcaaatatgttgttattcgccgtgggaagaaaaaatatttcttgttgacattttagctagttgctagagagtgaaatgagtaaaaagcgaaccgctgagtgggttcgctttttttcaaatcaatagaggaggaaacagatcgtttatgggacaattatttttgaatgccgctggtctctttgcaatgatctttttggggtattttcttaaacagctaaaggtcctatcaaaagcggatggatctattctgtctcggatgatcctcaatgtcactctgccagcagcaatcattcttaatcttgccgatatgcagatccaaatggacgcactggcattaattttaattgcggtaatcatcacgttcgtgcagattatgactgcctttttcctaaccaaaaaagagaatgatgtgttacgtcagttttcgatgtattgtggctccgggttcaatatcggaaatttcgcgattccttttgcacaaagtttttatccattaggaatccccttgatttcattgtttgatatgggtaacagtattatgttggcaggaggcaccaccattttgattgagtatctaatcgggaaacggacagtttttgagccaggaaaaatcattcttaatttattacgatcgccaacctttacttgctatttattcatgttgctgatccgcagctttgggctctcattaccgcaaggggtgatccagctagtccaacctatcggtaatgccaatacctttctatcgatgttcatgattggtttgtttttagattttcgtttaccgaaacatgctgctgcaacggtaggaaagattttgagtttgcgttatggaatcggtttgctattatttctctgctttttctttttacctcttcccgcttttttgaagcccgtgttgtgtttactggtatttgctccaattcctttattcggtgtgatcaattctgtattggcaggtatggaggaagaggcagtcggctttgtgtcttctatcagtttcttgattagtttgcctctcatgacactcgtactgattttatttggattggcttaatatagtggataaagtcaaagaaaacggcaagcaaaaaactagcgtgaatgaatgttttttcgcataatagacaagacttatttttaggaggaagacaatcaatgttaattggatcacatgtttccatgagtgggaaaaaaatgttgctgggagcggcagaggaagcagcaagctaccaagcaactacctttatgatttatacgggggctccacaaaatacccgtcgtaagaaaattgaagagatgaatattgctgctggacaagatttcatgacgaaagcaggcatttcgaatattgttgtccacgcaccttatatcattaatttgggaaataccatcaaaccagaaaattttggctttgcggtgtcgtttttacaagcggagattcaacgagcacaggcattgggcgcaacgcaaatcacattgcatccaggagctcacgttggtgcagggccagaagcaggtatcaagcaaatcatcaaaggattgaacgaagtcttggaaaaagggcaaacggctcagattgctttagaaacgatggctggtaaaggaacggaaatcggacgcagttttgaagaaattgctgcaattattgatggtgttacgctgaatgagaagctttcggtgacgtttgatacttgccacaccaatgatgctggatataacgtcaaagaagattttgatggtgtcttaaatgagtttgataaggtcattggactggaacgtttaaaagtaatccatgtcaatgattccaaaaatccccaaggcagccataaagatcggcatgcgaatattggttttggaacgattggttttgaagcattgaataaaatcgtccatcatgaacaattgaagcaactcccaaaaattttagaaactccttatgttggagaagacaaaaagaataaaaaagctccttatggttttgaaatcgccatgctgcagcaacaaacgtttgatccagacttgttgactaagatcatggagcaatgaaccacattatcctatggcgtaaaaaaagtctaacctagtctggaactgtttcgattattgaagaaagaatgggtttagcaggaggaatagatggagtttgatgaattgattactttcgcccaagcgaagattgcaccaagaaaactgtctccctgggcagaatcaggcggtgttgcagcagccatccttaccagagaagggaacgtttttactggagtgtgcattgacactagttgttctatgggtttttgtgcagaacatgcagctgcagcagctatgatcactgcgggagaacatcacattgcaaaagttgtggctgtggactggcaggggcatccgatctcaccttgtggtcgttgccgcgagtttctcagtcagctgtctgaagacaatctttctgcgcaagtcttgacgaaggcgggcagtctgccgcttgctcagcttttaccacttgattggaaagacggtcttgtttaacagtaataaaaaaatctcaggaataaagctgtcccataactgctagttcgcattgttggttcgcttatcattcctgagatttttaattttttattagaatttttttgctgcttctgccactttttctaggccggctgcaatgatttcttcagtttttgaagggtctgcattgtgaccttcaatgattacttcatcgctgatcgtcatgccaaacataccaccaaatactttttccataaatgtaacagcactttccatgccgctcatttcacctgagtaaacaccgccacgggcatttaacaagacaacttctttgtctttcaataattggttcatagatccatcttcattgtaggagaaagtgaaaccggcttggaaaatataatcgataaatgtgtgcaatgccgcaggaatcgtcaagttccacataggaaatgcaaagacaatcgtatctgctgctgcaaatttattcatgacgtcttgacggacggtcatcaattcttgttcttcttggtttaaatcttgttcttgtgctaattttccgaatgcttcgaacaatgtttgtccgatataaggcattggttgtgcgtaaacatcaaaagtaactacatctactgctgttcgatctagattttctacaaaagtatcgaacatttttgcagatactccgtcaggacggttatttgcttttacaactaaaacatttttcatcaattttccaccttttagatatatttaacatgtcacgagaaatagtttactataaaatcattttgcttacaataaataagtggacaatctttttctgatttttttaaggaagtgatccgttgcttttggtaaactagaagtactttaggaggtgcactgtgaaaatatttctaattgaagatgaaaagtcattagtcaaaatgattgaaagtcagctgtctcgctatgccttcgagacttttattccgcaggatttcgaaaagatcttggaagaatttcatagaatagagccagatttggttttgttagatgttaatttacctttttttgatggtttttattggtgtcaaaaaatccgcgagcaatccttggtacccattttgtttatttcggctcgtgacggtaatatggatcaagtgatggcacttgagtatggagcagatgattttctgatcaaaccgttttcttatgaattactcttagcaaaaataaaaagtcatattcggcgagtatatggagactatgcacagagcaatcgtgctcgccaactaaaagctggggaattgatttattatcctgaggctttaaagatgaattatctagaaaaggaagaagtgttaactgttcgtgaaggagaattgcttactttactaatgatggcttatccagaaatggtctccagagaacagatcttgaataaattatgggacgatgaacgttttgtagatgataacacattgtcagtaaatgttggtcgtctgcgaaaaaaaatggtaagtctcggtcttgatgaaccaatccaaacgattcgtggaaagggttatgctctttttattgccgggagaccagaatgaaagaatatttgaaagttcaattaccagcaattgctttatttgggatgtcgattgctttgatccttttgctcgtttggttagatgggtatcgcaatggttttgtgatcggctatggcttactattagtgggcttgttagcgataggagttttcacgattgattatctcgccaatcgcagtttctaccactatctaaaaacaggattatctggaagaagcgctggttacttagctagaagagtcaaaaagcttttagatgacgaccatcatcacgtacaagagcaactagcagcgattgatgcccatcatcaaacccatatcaaatttatgaatatctgggtccatcaaatgaaaacaccagtctcagtcctagaactgatggcagagagtagtcaaattgacccttacgatcttttagcagagacggatcgtttgaaaagcggattagccacagccttgaattttgttcgtctggaagattttgaagaagactttttgattgaatcaacctccttattagcattgatcaagcaaagcatcggtgaacagaagcgcaatttcatccggcatgaaatttatccgaaaattaaggatgagactgatttttggataacaacagacaaaaaatggttgcagattctactttttcaattgatcagtaatgccatcaaatactcgaatccgaaagcaacagtcacttttgcattagatgatgcgaacagaagtctgacgattacagatacaggttgtggcatttcagcggcagatttgccacgggtgttccgacctttttataccggtgacaatggacggcagcggggagaagctaccggtatgggactctatttagtctctctcattagtcaaaaactctcgattacggttacgattgcttctgaagtcggtcaagggactgtcctgcaattaaaatttcccgagagctaacgaaacttacaaaattgtaagttatctttcaaacaatcgataagtttgtttcagaaaacctgttacactgacagcaaaggagtgagtgctatggctttactagagttgaaaaatatcactaaaacgtatactggtgaagtatctgtggaagtgttgaaacaaattgatctcaaagtgcctgccggagaatttattagcattatgggtccttctggcagtggtaaaaccaccatgctgaatttagttgcgactctggatcaaccaacatccggctcggtcatcatcaatggcgcccaaccgctgacattgccaaaacaacagcttgctgagtttagacgccgacagttaggtttcgtgtttcaaaattataacttattgtctccgctaaatgtggcagagaatgttatgctgcccttaacattggatcgagtaccggttgatgagatgaaacggcgctgtgaagcgcttttgacagagttaggaatcaatgacaaaagaaaaaaacggatctatcagttgtccggtggagaacagcagcgtgttgcgattgctcgagcgctgatacatcagccagaactgttgcttgcggatgagccgacaggtaatctagattctaaagcagcccgtgatgtcatggaaattttgagccgaatgaacaaacagcgacaagtgacaacgatgatggttacccatgatccctattccgcaagtttctctgatcgtgttgttttcatcaaagacggcaaactttacaatgaggcctatcgcggaagtgatcagcaacaattttaccaaaaaattcttgatgttcttgcacatctaggaggtcgccgtcatgaatttcagacagttgatcattcgtaatttaagaggtaacttccgcacctatgctgcttatttcgtaagcagtacatttgctgccatggttttttatatatttagtctgcttttgttccatccgcaactaaaagaaaacttgtcagcgagcgataccatttccagtctagctaagatgggattagcggttgctttagtagtaattgcatttttatctttgatgtttctttggtacacctttgttgttttcttaaaacgtcgcaaacgtgatctcgcgatctatctcattttagggattgaagagaaggatttgcgaagaattctatttattgaaaatgcgttattaggatcgctggccacctttctaggggttggcttaggaattttgggaacaaagctattattgcttgttgctcagaatgtaatgcatctcaatcgcggattgtcttttatggttccattgactagtttgggattaacaatcggcgtgtatcttttgatgttcctgctgatctcattttttagtacgcgtgctttacaaggggaaaagatcatatcattgatcaaagaaaacgagaagcccaggccggagcctgtgagtcgtcggatctatgcattccttggggtgcttttgctctttgtcggctacggatgtgtgttttatttttctttcaaagctgacggttttttgattcttttattaggcgttttgttgacggtagcaggcacgatcttgtccttctatcagtttagtgtttacttattgaaacaacttaaaagaagtccttcttttttacaaggaacacgcttgttaacgattagtgaatggatttttcgtatgcgggacaatgcggcaatgtacagtctgatcgccattagtacatcagtggcttttgtaggaatagcagtaatgatggcgattggcaacacttcgttttcttcgattcaaggaattagtgtagcgtatgttttttcggaatacgaaaaagatgaaataggtaaaacgaaggcgtttgaagtgaaagaaaaattggaagcgcaaggctatcatccggttatggaacaagtggatctcattgagacctacacaaatcttgaaaatccagcgattgctattgatccatattacatgaacaatgcattttcattgatgagagaaagtgattatcgcaaattgatgagccaaatcggagaaaaagctgaacctgttatggatgatcaagtgcttgaacttagcagcaattattcaagacgtaaagaactgttgtcggttgaccaaagccaacgacaacatgtgtatccgctggaaattggcggagatagcgattttcagcaagatatgacgatcgttcatagtccctcaatgctttcgttgaactattttggccttggtgttgtaactgatcaaacttttgagaagtggcaaaaagaaattggtgattctgaagattcgggaggatttgtttggttagattaccccgagtgggcagacgatcctacgttaattgatggtatcaatcagcaaatcgatcaagaaaataaagaaacagatgaaaaagtatccgctatctacgatgaattaggagcagacaaagtcaacgagatgtccgatgaagagtggtcaaaagcacttgaaggcattccgtctcatattggttatcaatcaaaatacaaagttttccaggaaacacgtcaaggcaatggtctcattttaatgatcactgttttactgggctccgttttctttattttctctgcatcaatcatctatttccgcctgtttgcggatcttgacaaggacggcgcttaccatcgctctttgcatgtgcttggtgtttcaccaaaagaacggcataaaattctgcgtcatcagctacaagttatgtattttttgccaactatcgtggcaatgattcattttgctgttgcgatgaccgcactgcgtttattagttgaattgcccgtttggcagttctatggtgaaatcgtaggtatttacttattgttccaagttattttttatatttgttgtcaactacgttataatcaacaaattgatcgctatgcagatccaacagaataatcagtcagtctttttacaaaacctatcgctttgtttgagtgataggtttttttctgtgaaaagcagatgattaatttgaaagtgaagccctgccttgtgatataactcgcacagttcgtatgacttgcttctgaattttccgtaaattatactggcggtgacctattaactatcagggagggatcacatgctttcaaagattgcaaaagtacttgttgctctgttgctaactatccccatttttaccggtatggaaatcgtatacggagagacggatgtgggggcaaacttaatcactgatgtatccgttgtcaatagtcagaatcaagaagtgacgactttagatgaagacgaatctttcaaaattgatctcaaatggagtctcgaaggattaggtgacttaaaggccggggacaaagcgacgattatcctcccagtagagattgaaggtgtcaataatagctatgaactgtatgatgagaacggtcatttagtagtaaatctcacccaagttgggaatcagcttacttttgtatttactgagtttgttgagcagaacaacaatgtgcatggagatttttacttttggacaaaatttagtgaagacattaccgtcgatcagatcaatcaactcgattttgaaacagttaatggaattaagacaattcctttatttattcgaggggttgaggatactggaacaggtgcattacttacgaaacaagggctttatctaggcacacaagaacccaaacgaacgattgattggcgtatttatatcaattcttatgatacgaataaggtttcaattaaaaatgggagattcattgatactcttggaccccatcaagcattgatcagcaccacggcacgagtggtgtaaggtccaagcgtaactaatcccacttatgttgaccaagtcccaattacgcttaattcagacggcacttttgaaattcctttgcgggatacgagtgagagaatctatatcacctataaaacagaaactgatgggtctttggagcaatatacaaacaagggaaccattcaagcattgatcaatgattcagcagcagtccacacaactactggctacacgccgaaatatggaggcgggggcagtggtaccggagaaacgagcacttcaagcgaaagcacgaccgcaagcagtgaaagtacaacaagtagcacaagtagtgaaagtacgaccgcaagcagtgagagtacaatgagtagcacaagtaacgaaagtacgaccaatagttaagtagcgagagtgcgacttccaacagtaatggtaatagcgtggacaactcttcattatccgctcctaaagtaagtcagagtggggcaccgccaaagaatggagggaatcctcaattaccgcaaaccggaatgaccaatgataaatggatgattctcgggggcatgcttttgatttcttacgttatctataaacgaaaataaaaagaaaaaatgaattggagattggatgaacgtgtgaatgtatcgtttcaaatctaatatccttacagatttaaaaggctgaacataagaagagacaaaatattgatctagttagtggtagtttgctgctggatttttcgaagaattcgctgcgactttttgtctttcttgtgtcagtcttttttggttgttttctgaaaaatgccaatttccacctgattctgtcttttttttggcgcgtggttaactaaaaaaactactataatctcattatcaagttaacctgaaatagatttaggaagtgagcaaatgaataaaatccccttgttgattgccttttttattattttacttattgttttctttaaaatagatagtttggcaaatgaacgagctcccggtaaactatctttgactttacgaacgaaccgtatcatttatgatgagcagtcaaagtggatcacgatacctattcgtccgaataaaacacgatcagccaaatcggttcgagcagtgttaacttatggttgggatggtaagggtactgagaaaaaggtcattggtgaaacgactttaacgaatgtagaatgggtttccggtattgagaattttttaagaattcgtggagatttaccaatgtctgagatcaagtgtaaaaacaaagtggatttagtgattgtttacgatggtgacgttacaactatagagaatttaaagccaagtaaatggagtattgttgatctaccgtcttcttctgagagttccagcattgacactagtatacttaaggagacgagcaatcccaatagtctttcctcatacgataataatgatgaaaattaattgtggcaggacaaacactcagaacagaaaaagacatttaagaagttcatttaatattgtaaataaaaaagcggtcgctgctgataatgaagtaaataaagaatagtcagattggcatgtaaactctcctgagagattgtcgcaaaaaggcagaacaagcaaaatgattggaaatttcttccccagaaatgaacagttacaatttattcggctcaacaaatcgcaagatttgttgagctgatattttttaataaaagactttgacgggtagtttgacaatcgttcctttgaagtggtatgatcgcaaaacattcactaacttacaatattgtaagatctttttagttgtccagatgaaatcaaacttaaatgaaggcaaagtttgaataactatttaagcgagggtcaatcagtgtttcatgtattatttgacacaacagaaaaacaaatcaaccagtttctcacctattgttatgaaaggaatcaaacaacttattcaaccaaagagctgatggctgtgtttaactataaaactagcaagctattgtctgttattcaacaggtagaattatttcaggagcaatattctgagtatacggttaattatcaatcagaatcaaaaactatcaagatagaattttcacctagatttctgctaagcaaagtttatgcaatcttggtggaaagaactgtcggatttacctttcttgatttgttgtttaagggaaagtaccactcattagagcaattaagccaagagacatatagcagtttacggacgattcaaagaaaattgactgaattgaatcaagtgttagcaaattatcatttatcatacagtttaagaaaaggaaatccacttgaaggaaaagagtactacatacgttatttttatcatgtcatgtattggcagttgtttgatgaaacggactcagatcttttagcaacgataagggacaagcaaactattgctactcaaattgagcgtcacgctccttacatgcgaaaaattgattgcaataaatttttatctctgctggctatttcattgcagcgaatcaaacagcgacattttatcgtagaaattcctgatgaaataacgactttcgagcatccattgatgactaaaagaaagttcaccgaatgcatactggcacctttttttcaggcaaatgtttacgctgtgagtgatctcacggacgaagaaatcagttttctttattttatgtttgcagtaatgaatacatatttggaagaggatctgactgaaatccatcaggattggtttgataatgagcagtattcgactgaggagatcattattgacaaactgtctgcatactttgatttggcactcacttcgaaagaaaaaaattatttattggtcaacttactcatgattcattcctactcatcagtttttggaacagaacataaaatagatgggtttggaaaacaaacgagggaaagtgagcttgaagcttatttcccagtcatgtacccaacgatgagacgatttttgatcgcaataaaaagagaaatccctccacttgtcgggtttgcaaagaagaatgatcgtcttatctttcaatactgcatgctcgttcgaacagtctttattaaatatgagcgtccagtaactttttctattcaatcgaaatttggcaagacacaagaattatggatcaaaaatcgattgttgaacacctcccatcgagcaatccagcatgttccttcagttgatgaaccagatattctaatcagtgattacccaatctatcgccagctaggggcaaacaaacaaatggagattttttattggaatggtcagcccaccagcagtgactgggaacgtttgaaagaaaagattcataaaattcggagcgaaaagcataaacaggtttttgacagcctaagtttccataagttttcctagcagcagatgaattattcacatttcggagaaaacacctctttataaatttatatgttcagtccaattccatcatttgttaaatgacaatttgatttctactacgtttattttttattaaatcatgtcattaatttaaaatcccaatttgatgaagctggctcgtattctttgaagttcattcggaagtaagaagaccaaattgaaaagatcattctttttcctgttgactttttaatactctagtgggatggtagtaataactattatcatgaaagtaaaaaaatagcgaataggaagtagggatgaaatgacagaaatactaacactgaaaaatgtatttaaactgattggaaccaagcaaatcattgataatgcttctttctcagtggaacaagggcaagtggtcgggttattaggaccgaatggtgcgggtaagacgacgattattcgaatgatcgttggcttaatgaagcacaataaaggctcaattacgatcatggggaattccctagaaacgtcttttaaagcagccattgcctcggtaggagcgattgtagaaaatcctgagttctacaattatctgactggttacgaaaatttgatgcaataccagcgcatggcgaagacaaaaatgacggcagttgagatggatgacttgattcgccaagttcatttagaagaatatatcaatcaaaaagtcaaaacgtattcactagggatgcgccaacgattgggtgtggcacaggcattaatccatcgtcctactctcttagtattagatgagccaatgaacggacttgacccaaagggtatgagagagtttcgggaaatgattctcatgttaagagaacagggtgtttctgttttagtatcgagtcaccaattaagtgatatcgaacagattgcagatcatctgatcgttgtccaaaaagggaaagtgacccatcaagtcgcgatggataccttgaaggcagaaaaaagcctactgatcatcaaaacagatgacgatcaggaagcattaaatgtcttgaagactaaattccaaatcgatgggcttgctttgacggatggattacagatttcacttgaaacggataatcgttctgagatcgctgctgccctcgttaatgcagggattggtttaaaggaaatgaaattgcagcaatcttcgttggaagaaacatttttggcttggacggaagagggagggctctagaatgaggacactaataaaaaatgaatggatcaaagtcacgaaaaaaaagtccacatggatcatgttgggacttttggtggttttaacattcggactcacctatgtggtccgcttaggctcgcctgatactaaagccaacgatctatttatttttctaagcgacatgacgtcatttttgaatttatttgttgttattgtggcagcttcagcggtagcagaagaatttagtcgagggaccatcaagtttttgttgattcggccattttcaagaagtcagatattagccgcaaaagccatcaacacactcttatttgctttgcttggcacactggttttatttctaagcagttttcttgccagcaatttgtttttggtatctgaatctcccttcacatcaacggattataatcaattgccagctatagttgtggctcttgtctatgcagcaacaaatttactgttgattgtattttatatgaccatgactctgttcatctctgccgtcattcgctctcaaagtatggcagtgggattaggagtagctgtgttgttcgggagcagcatcatcaactccatcatgctttttgcgatagaaaaatatccttggttgaagtggaatccatttaattttatgaatatcaaagatacggttcccacattattgcatcaaacggatatgcaaaatgcaataattgatccgggtttgaattattgggaaatgacgattggacttttgttatacagcttattgatctactttttgacaaactggttgttcaacaaacgagatgtggcattaagctgatatatagagggaatgtttttggagaaatcctgctttctctctttctttttgtatttttttctagtaaaatgattcattgagagtacaagagaaaggagagatttcaaatggttagtttaggaattgtaatcgtgatcgctgttatcgcggtattattaggcgctgtcggcggcttctttttggcgcgtaaatatatgcaagattatctgaagaaaaatcctcccgttaatgaggatatgttgcgttcgatgatgatgtcaatgggccaaaagccttctgagaagaagattcggcaaatgatgcaacaaatgaaaaaccaaaaataggttttttagcgcaaaaagcgggctgatcccatcagctcgctttttgttgcgagtcactgcgattgaccgcgtcagcgaggcagagcagatgaggaggaatacctactcggtgttgcgagtcactgtgattgaccgcgtcagcgaagcatgcaagttcatcttagtgattttcgctagaagaactgtaagcgaagcagagcgtagataagcagatgaggaggaatacctcgtgttgcgagtcactgcgattgaccgcgtcagcgaggcatgcaagttcatcttagtgcttttcgcttagaagaactgtaagcgaagcagagcgtagataagcaaatgaggaggaatacctcgtgttgcgagtcactgcgattgaccgcgtcagcgaggcatgcaagttcatcttagtgattttcccttagaagaactgtaagcgaagcgtagatgagcaaatgaattgtgcctatcgttgggtaggtaacaaaacgtgtttcgcgaggaattgaaatgtaactacatcggaaggtcagtcattgccaaaatagtccgaaaatttcgatgattcaaatcgtagccaacaggagtgaataataggagggtgttatgtcgatttttagaaagttaggttggttttttagacaagaaaggaaacattattatataggagtagccgcattggttttggtggctctcgttcaattagcgccacccaaagtgattggaatcattattgatgagatcgcagaaaaagagatttcgatagaaacgattttattttggataggtattttgcttgccgctgcattagcacaatatatttttcgttttgtctggcggataaatatttgggggagtgctgcacgcttggaaaaaagcttacgtcgtcaattattcgatcacttcaccaaaatggatcatcttttctatcaaaaacatcgaactggagatttgatggcccatgccaccaatgatttgaacgccattcaaaacgttgctggggcgggtattttaacctttgcggattcgtttatctctggaggagcaacgatcatcgccatgatcctttttatcgattggcgtctgaccttgattgcgttgattcctttgccatttcttgcggtcatggctagagtgttaggcagcaaactacatgatgcttttcgtgattcgcaagaagctttttcagcgattaatgacaaagcacaagaaagtattactgggataaaagtcatcaaaacgtttggacaagagacagaagatattcaagattttcaagccaaaattgatgatgccatcatcaagaaccgtaaagtcaattttttagatgcactttttgatcctttcattacattgattatcggtgtctcatatgtcttaacgattattgtgggtggtcgttttgtcatgtcaggagagatatcgattggccaattggtttcatttattagttatattggtatgctggtttggcctatgttcgccattggccgtctgttcaatgttttagaacgagggaatgccagctatgatcgggtatctgaattgctgggggaaagaacccatattgttgaaaaaaaacacgcgatccaagagccggctcaaggtaaaattgaagtggcgttagacgcttttcgctatcatgatgccgaagaaatcacgctgcaacagatagcatttaccttacatgaaggacagacattaggaatcgttggcaaaaccggtgcaggtaaaacctccattttgaagttgctgatgcgggaatatgatcattatgagggtgacattctttttggcgggcacagcatcaaagattatactttgaatgcgttattgggctctatcgggtatgttccccaagatcactttcttttttccatgtcgattcgagacaatatccgttttgcggtaccccaagcaccacaagaagcggttgaagcggctgctgatttggcgtcaatcaatgatgacatcaaagcattgccagaaggatacgaaacaagggtcggtgaacgaggggtctcattatctggcgggcagaaacagcggttgtccatcgcacgggcattgattgttgatccagaattactgatcttagatgatgccttgtcagctgtcgatgccaaaacagaagaagatattttgcacaaattgcgagactatcgaaaagacaaaacaacgattatttctgcgcatcggctaagtagtgtgaagcatgccgaagagatcttagttatcgatgaaggaagaatcatcgagcgagggacccacgaagccctgttagccaaaaatggctggtacaaaaaaatgtgggacaagcaacaactggaagccaaaattgaagggagtgaagtataatggaacgtcaagaatctgaatggtcaaaatcaattccatttaaagagcaaaaattgatcatcaagcggatgttacaatttgcaaaacccttcaagaagacattttttgcagccattttctttgcttttctcttatcaatcgtcaacattctcctgcctagaattctgcagacattcatggataactatctgacacaacagtcagcaaccaatcaaatcatctatttctttgcgggtctctatttctttggggtagtcatcaaagcagtcatctggttttttcaatggtttctatactcgatggcttccttgcagacgtatcaatatgtgcggaccaagttattcgagaagctgcatagtttaggtatgcggtattttgatcagactccagcaggttcgattgtgtcgcgggtcagcaatgataccgaaacattgtatgaattctggtatgtgtttttgatggttttgactggtatttttgcagtcctatcttcttttgccgccatgtttcagatcaacgtaaaaattgctttattgaatctgattttcttacctatcttgatgatcgtcatctggtattatcaaaaattcagctcccgaatctatcgtcaaatgcgagaaaaattaagtcaattgaatacgaaattgaacgagtcgatctcgggaatgcagattatccagcagttccgacaagaagcacgtctgaaccgagaatttgaggaaacgaatgatgaatacctcaagacaaggtatgcaatgattcgtactaattcgttgctattatcgccgatcatcaattttctctatgcgattgcagttgcgatgtcattaacgttgtttgggtttgatgctttgcattctccgattgaagtggggttgatttatgcttttaccacctatgtccaaggcttcttcaatcctatgacacagatgatggattttctcagcgtctttactgatggcatggtggctggtagccgtattcttaaaatcatggataatgaagaatttaccccacaacaacatccggatgcgaatcaagtcattgaacaaggaaagattgaatttcgtaatgtcagtttttcttatgatggagaaaatcatgtattgaagaatatttcctttactgcttatccaggagaaaccgtcgctttggtgggacacactggtagcggcaaaagctcgatcattaatgttttaatgcgcttttacgaatttggtgagggacaaattttgattgacgatcatgatattcgcgattttacgatcgaagaattacgaaaaaaagtcggattggttttacaagatgctttcatgttctatggagatatttctgacaatattcgtttattgaacccagaaatcagcgaagaacaaatccgagcagcagcgaaatttgtgcaagcagataaatttatcgaaaaactggagggcacttatcatgccaaagtgattgaacggggcgctagctactccagcgggcaacgacagttgatctcatttgctagaacgatggtgactgatcctaaaatcctcgttttagatgaagctactgccaatatcgacaccgaaacagaaggattgatccaggaagggttggcgaatatgcgacaagggagaactacgattgccatcgcccaccgattatccacgattcgggatgctgaattgattttagttttagataaaggacgtatcgtcgaacgaggaaaccatgattcattgttaaaacagcaaggcctttatgcagatatgtataaattacagtccagtgacgtgtgattagtcgggaatattttttgctgtttccttccagtggacactaactaattactagaattccatgtatccatcactccatcactttgttggtgttggcttgggagcgggtatgtggggttcttgtttttcatcgattcattttataaaaggaatcaggaggaagtaaaataacgaatccttttttcggtcaatgtattgacagcgttttctctgtttgctatcataaggataagttaatcattcgtatggatagtgattgttgaaaaaacaagctaaacctgatgaaagtaaggctatttggtctgctctcattaggttttttttctggaaaaaaggagtatggatcaaaattgatttgaatggctatctcgtataaaaataggttagtacgtcaataatcaagtgggggtaaaacatgaaaatcagtaaagtgttaaacaataatgtcgtgataactactgatgaaaaacaaaacgaaattattgtgatgggaagagggatcgcattcaagaaaaaagttggtgacgatatcagtgatcaaacgatcgataaagtatatcgtttagaaaatcgtacaattgcttcccaatttcaggaattattggccgacttgccattagaatatttggaactttcgaaccaagtaatcgaatatgcaagagaagagttgtcctcaccgatcaacgattcgatctatatttctttacctgatcatttacatagtgcaatcgagcgtgccaaaaaagggatcgttgtcaaaaatgttcttctctgggacatcaagcgattttttccagatgaattcaaaatcggaaaacgaacgattgaaaaaattagtgagcgctatgggattgagttgccggaagatgaagcgggtttcattgcactgcatttggtaaacgctcaaacagaaaacaatgatcaaagcaatctttatgaattgacgaaaacaatgcaagatatcatcaatatcgtcaaatactattttaaaacaactttcgatgaagaatcggtttatttttatcgttttactacgcatttgcgtttttttgtttcccgcatgcagaaccactctacccatgcggaagagactgacgatcagctccttgagatggtaaagataaaatatcgcaacgcctatcaatgtgtgcaaaaaatcaaatcatttctggtaacgaattatcgttacgatatgtccaatgatgaaagtttgtatttaacgattcatattgcgcgattggtgcaaaagaatcgctaaccataaaagaaaggaggtcatcccagaataaactggggaatagtaaagcattttttggatagtgacattcagttggctaaaccttcaatcaaacaaaaattggaggaaacaaaaatgggaaaatatcatgaattagcagaaaaaatcgtggcaaatgtgggcggaaaagaaaatatcaatagtttgacccactgtatcactcggctgcggtttaaattgaaagacgaaggaatcgcgaacgatgacatcttgaaaaatatggatggggtcgtaacagtgatgaaaagtggcggtcaataccaagtagttatcggtaatcatgtgccagatgtctatgcagaagtagtggatgttgcggggatcagtgaaaacagtgaagaagaaagttccggagggaatattttcaatcgtctgatcgatatcctcagcggttgtttccagcctttcttaggtgcgttagcagctgccggtatgatcaaagggtttaatgcattattagtctttttgggtacacagggttggttcaactatacagcagaatcaggcacatatgtaatgttgaatgcgatcggtgatgcaatatttatgtttatgccggttattttaggttatacttctgcaaaaaaattccgtttgaatccgatggtcggtatcgttattggagccgctctatgctacccaacgattcaaggcactgcgctgcaaacagcctttaccgcagttgccggagaaggagcagcagcaccttatagcttacttggacaatctgcctatcaaactttcttaggtattccatgggtaggggcaacctatacaagtagtgtcgtaccagtcattttcattattgcatttgctgcacagattcaaaaacttgctaaaaaagtgattccaagtgtcgtgcaaactttcttggtaccatttttcgtcttactgattgctttacctgttgggttcttgatcattggtccaatcatcagcatgttgacagatctcttgagtgccggattccaagcgctaatggacttctcgccagcggtttatggattgattctaggattcttctggcaagtattggttatcttcggcttacactggtcggttgtgccactagcgatcatgcaagttacgcaacaaggattcagccaagtgttgacaggttccttcggagctagctttgctcaaacagcagttgtcgttgccatgtatttcaaattaagagacaaaaagatgaaagcattatgtccgccagcgatcatttctggtatctttggtgtaactgaaccagctatttatgggatcactcttcctaaaaagactcctttcatatattctatgatcggtggtgctgtcggtggactgttcttaatggtcaatggtgtaacgggctacacgatgggcggacttggtattttcgggatctttaacttcatcacaccggatggagatgcgagtggcatgtggacttcactgattgctatcgccatctctgcagcgattggttttggtttgacgatggcattctggaaagacaatacagtagtcgaagaaattgctgaaggcgaacctacaatgtctgtacgtaaagaaatcattagttctcctatcgaaggaacggttgcacctttaagcagtgccaaagatgaagcttttgcccaagggatcttaggtaaaggaatcttgatccatcctacaaaaggggaagtcgttgctccatttgatggtaccgttatgacattgttcccaacgaaacacgccatcgggttgatctcagataacggattggaattgttgatccatatcggtttagataccgttcaactcaatgggcaatacttcgaagcgcatgtcaagcaaggagatagagtaactcgaggtcaaaaattgattacctttgacaaagatgcgctgatcaaagctggtttcaacattgagacccctgttttggtaacaaattctgctgattacttagatattattgaatcagataaaaatgaagttgcttgttcagatgatttgattacagctctcgtttagcaaaaactttctaaaaagagctatatatgcataaaagcgatcggccatgtggggcgatcgctttttgtcagccgtttaattcggaaacagagagtctttgtattgaagatttttatcgtaggttggttcagcgataatcgttgaggaagtaggacgtttgtcataagccatgccaatatcgatcaaatgctgaagatttttttcataatgttccgaaaagacgattccatacagcacatccagtaggtagcaaacggacgtattaattgtgaaatttgcgatctttgagtaaagcctttctcgggttgtgatatttaagacacaatcacttaattttgccaatgcgttctcgccaatactagtcattccaataattgaaacttgacgttcggcaagaattttaccgatttctttgatcatcttgttttcaccagtataagaaatcaagatggctgtcgtatcagaagtacagttggatgcttcataagcactttcgccaaaagtgtcacaaacatggatgttttttcctaaacgccgcatcttcaaaacaaagtcttgagaaatcaaggtattggcattacttgcgaaaatcttgatatggctggcattgagtagcgattgtttcgctttttgcagttcatcgtgatggatcaaggaaagcgtatcttcaattgttgtttgttcgagtttcgctaactttttggcgatcgtcataatgccgtcatgggaggaaaagggaaagttggcatcaacatctgtaaaatgactgctcatataggtttgctcttccaaaaaggctgtctttaagtcgagccaaccgttgaagcctaattttttggcgatccgaataaaagtagaaggatgaacgtaggttttttcagacaattccttgatggtttgatcagccatcgcagttggattggctaataaaaaatcgatcaaagatcgttcagcaggggccaacttgatttggcgcattttttcttgtaataacatggtatccacattcctttttacatttttatatagttgtttgtaaataaaattatcggaaatttttcttttttgagtatttgaataattgtcgatataaatattattccttatatcattcgatttgtaaatgctttttacaaatcactcgcaagatatccctagatttgcaaacgctttttctaaataataaatttacattgaatcgaattattttataaatgataataagggtgtaaataaaatagcaaaggagcaatacaatgacaaaaggaatcaaaatcgctaccattggtggcggcagtagttatactccggagttaatggaaggctttatcaaacgctatgaagaactgccaattcgggaaatttggttagtagatatcgaagcaggaaaagaaaaactggcaatcgttggagcgatggcacagcgaatgtgggatgcttctccttatgatgtgaaaatccacatgacgctggatcgagaagaagccttgaaagatgcagattttgttacgactcaatttcgagtaggcttgctgaatgcccggatcaaagatgagcgtattcctgcctattatggcatgatcggtcaagaaaccaacggtcctggcgggatgtttaaagcatttcggacagtaccaattattctggaaatcgtagaagatatgaaacgcttatgtccaaatgcttggttgattaattttgccaatccaagcggcatggtcacagaagcggttgtccgttatgggaaatgggatagagtgattggactttgcaatgttcctgtgatggcgaccatgatcgaacctgcattgatcggtaaagagccggatgagttaatctacaaatttgctggcttaaaccatttccattggcataaagtcactgactcacacggaaatgatgtgacgatggatattattgataaaatgtatcaggaagataatggtttgccgaaaaatatttttgatgtgccgttttatcgtgaacaattagaacaaatgagaatgattccttgcggttatcatcgctattactatcgtcaagaagaaatgttgaagcatgcactggaagaatatcagactgtaggaacgagagcgcagcaagtgaagcaaacagaggcagaactttttgaactttataaagatccagaattggatcataaaccagaacagctgcagcaacgtgggggagcctactattcagatgcggcttgcgaaacgattgcctcgatttatgcaaacaaaaatacccagatcgtggtctcaaccaaaaatgagggagctgttcctgacctaccggctgattgtgttgtcgaagttaccgcgtatgttgggggacaaggtgcccgcaatgtggcttttggcgagctgccgactgcagaaaaaggctggctacaagtaatgaaggctatggagcttttaacgatcgaagcagcggttactggcgattacaataccgcattacaagctttcaccattaacccattggtgccatcaggagaaacagctaaacgcgtaatggatgaattatttattgctcacaaagcttatctaccaaactttaaatcaacgattgagcgtttggaaaaagaaggaatcgaagttcaagacgaactggcaaaatcacttaattaatcaacaaaatatcaagaaagtaggaatgaaataatgggatttagaaaagactttttatggggcggcgcaactgctgccaatcagtgtgaaggaggttacaacgaaggtgggcgaggcttagccaatgtcgatgttgtaccgatcggtaaagatcgttttccagtcatcacaggacagatgaaaatgtttgattttgatgaggatcatttttatcctgccaaagaagcaatcgatatgtatcatcgttacaaagaagatattgctttatttggagaaatgggctttaaaacctatcgtttgtccattgcttggagtcgtatttttccaaaaggggacgaacaaaaaccaaatgaagacggcttgaaattctatgaggatctcttcaatgagtgccataaatatggtattgaaccactggtaacgatcacgcactttgattgtccaatgcatttagtagaaaaatatggtgcttggcgttcacgagaattagtaggcttttatgagaatttatgccgagttatttttaatcgttacaaaggattggtcaaatattggttaactttcaacgaaatcaacatgattcttcacgcgccatttatgggagctggcctctattttgaagaaggcgacaacgtggagcaggtcaaataccaagcggcccatcatgaattattggcatctgcgattgcgacgaaaatcgctcacgaagtagatccggaaaataaagtgggctgtatgctggctgcaggtgcctactacccttacacaagtaagcctgaagatgtttgggcatcaagaaaatcagatcgcgaaaactatttcttcattgatgtccagtctcggggagaatacccacaatatgcattgaaggaaatggcccgtaacgggattgagatcaaaatggaagaaggcgacttagagttattgaaggcccacacagttgattttatttcattctcttactactcttctcgggtatcgacaacagatgctgagctattggaacaaacttctggaaatatttttgcttcagtaaaaaatccttatttggaagcaagcgaatggggctggcagatcgacccattaggtttgcggattactatgaatgacctttatgatcgttaccaaaaaccattattcattgtagagaacggtttgggtgctgttgatacaccagatgctgatggctatgtggaggatgattaccgaattgattatcttgcagcacatatacaagccatgaaagacgccgttgaacaagatggtgttgatctattagggtatacaacatggggatgtatcgatttggtctctgcgggaacaggtgagatgaaaaaacgctacggttttatctatgttgatcgcgacaatgaaggcaatggtacgctgaaacggacaaagaaaaaatccttcgactggtacaaacaagtcattgcttcaaatggcgaagacttaacaaacaaataatcatgcttgcggcttcttcttggatgaattctaagaagaaagccgctgatagtctttacgatggagggataatatggggtttccaaaaaattttctttggggtggcgcaacagctgcgaaccaatatgaaggcggctatctttctggcggaaaagggttaagcaccctcgatgccattacaggaggcagtatggatcagccgcgaatgattacctataaaacaaaagacggccagatcgggaaagttactcgggataccgaattacctgaaggtgccgttgggtacatcgatccagagcagtattatcctagtcatgtggcgacagacttttaccatcattatcaggaagatattgcgttgtttgcagagatgggctttaagtgttttcggatgtctatttcctgggcgcggatttgtccaaaaggaaccagagagatcaacgaagacggcctggctttttatgatgcagttttcgatgagctgttgaagcatggcattgagccagtggtgacgatcaatcactttgatattcctatgtgtttagcggatgaatatgatggttggtcgaatcgcaaagtgatcgactatttcttgtttttctgcgaaacgatcttcactcgttaccaagataaagtgaaatattggatgacgtttaacgagatcaactttttgagaagttggacacaaattggtattcataaaaatgataagcagcataagtatcaagctgctcatcacttgtttgtagcaagtgctaaagcagtacaaatgggacaccgaatcaacccggatttcatgattgggatgatggtggcgtatattccaagttatccgatgacagctaatccagaggatgttttagctgcattgcaattcaatcgggaacaagaattctatattgacgttcaagcaaaaggctattatcctgcccacaaggtaaaagagttcgaacgtgaagggatcgaaatcaaaaaagaagctggagatgacgcggtcattgcgaacggaacggttgactatatcggttttagctattatatgtcaaccgcttcttcagcaaatcctgaaacagtcaagtatgttggcggcaaccaaatgcctgcggtgaaaaatccttatttagccgaatcggattggggctgggcggtcgatccattagggttgcggatctcattgtgtcaattgtctgattgttatcatcttcctttatttgtagtagagaatggattcggtgccatagacaaagtggaatctgacggctcgatcaatgacgattatcgaattgattatttcaaaaaacacattgcagccatgaaagatgcgataactcttgatggcgtagacttgattggctatacaccttggggatgtatcgatcttgtatcggcaggaactggtgagatgaaaaaacgctatggctttatttatgtggacatggatgatcacgggaacggaacattggcccggaaaaagaaaaaatcatttgattggtacaaagaagtgattgcttcaaatggagaacaactttaaagaataagaaaacatccccgcattcatggcgcaaacagcagtgagagagtattcattgctgttgcaaaccgatgagtgagtggatgttttttctggttagatcattagccaagaaccttttcaatactagggatcattttggttggattggtctgaggggcaaaacgttcaacgacatgtcccttgcgatcaattaaaaatttagtaaaattccatttgatcgctttccccatcgttcctggggcttcttcctccaagtattgaaaaagcggatcagcttcttttccgttgatgactgtcaattgatgcatcggaaagtcaacaccataggttgtgcgacaagcttcggcagcttcactagcagaatgaacttcttgtttgaattggttggaagggaagcctaagaccatcaatccttggtcgcgatatcgttggaacaattcttcaagttcgttgaattgggggctcaatccgcattttgtcgccgtgttgacgacaatgatggcttgcccccgatagcgttctaatgaataggtttcaccgttttccaaagtggcttgaaacgcgtaaattgacatttttttgctcctttcgatagttgacagtattttctaattgttgattgttcagtagttctaaacttgtaattagtatatttcaatctggaggaaaaaccaaaaataattgattttctttcagcagtaaatagacacaaggcagcaaaaaaaggttgggatcagaagtgttaaacttcgataaataaggaggaatatatggaaattgcttttcaattttttggtatttcgacttatttccgaagacattgtttcggctaccgctgtttagacgtgtttagagcgtgaaacaaaagtattttttacttttgtttcacgctcttttattcgctttgacattcgattgtctaattggcagaaaagatgacctttttagcaagtcattagatttctgaagcgacttcgccttcaatttcttttccatggactaccgatttggttttccacacaccggaataccaacgataaatcattaaaatactccgcaatgcttcatcaattgcgtaagcgatccagacaccaatcaagccaaatttaaagacgatggccaaagagtacgagaatggtaagctgatgacccaaagaacgatcaaactgcagaataatgggaatttaacatccccgctggcatttaaagagcccactagaatcatattgaccgcacgtgctgtctctaggacgatttcaacgagaaatacgcctttagcgattgagatgacttcagtattggtagtaaagattcccataatcggttcgataaagagataagtcaataaacaaattgtaacagaagcgatgatgccaatgatcattgtgcgcatgccccgtttttgtgctcgctcaaattctcctgcgcctacatgacgaccaatcatgatttgatttccctgacttaacgccgaggcgatcaaatacacaaattgagtgatcgctgtaacataagacttagcaatcagcacgcttgaacctaattgcgcaacgatcatcgttactaccacttgtgctccttgataagacaaagattctcctgaggaaggtaggccataggttaagacatttttcattacatcccatgataaatacttcaatcgggcagaaagaacagaaaaaccaacgtgttttttcagtaaaaatgccgcaacaatcaagccaatcgtattgccgaagacactggagaaagctagtcctgttacaccgaaattaggtaagccaaaaggactgtaaagtacaaagtagttaccaataacagctaagatactggcaaacatcggtacaagcaaagcaggtttcgtaaagctgtggctacgcatgaccgcgataatgacagctgtcagcgaagaaataaacaagcttccgccatatacttgcaggtagccgcgacccaaatcaaccaatgcttcttctaatcccataaaatgcagcaattgatcagagccaaagataaacatcaagctgatcaaaatacctaagaatagagaaccaaaaagtgctgtattgatcacagtagggattttatctcgctgcttcgcaccaattagttgagcaataatgatttgcgtaccaacagtgatgaaaccataaataaagacggtcagattcagcaattgatttgctgcgctgacggcagcgactgctggttcagaataatgggaaatcatccatacattgacattcccaataatcacacgtaaaaatagttcaacaaaaatcggccagctaagaaacaatagttcccgatcagatcttttcaaaagttttttcttattcaattgtaaggactccccgttttctatataatagatgtatcgtgaaaattttacaaaaaatgaaaagaaagtcaatgtaattttcagagaaaaaaacgggaatatcttattattttttgtaagcagaacattcgacagaaattctttttgaaagtaaagtatgggtagtcgaaaatggagggaacaattatgtatgatgtaattattatcggcgctggacctgccggcatgacagcagcgctgtatgcgtcacggtcaaatttatctgttctgatgattgagcggggagctcctggcggtcaaatgaataatactgctgaggttgaaaattatcctggcttcgattcgatcttaggcccagaacttgcttttaaaatgtatgaaagtgccatccgctttggcgtggagaatgcctatggcatcgttcaagggatcacggatcatggagagtacaaggaagtctgcacagaagacaagaattatcaagggaaaactgtgatcattgcaacaggctgtgtacatagaaaattaggagtcaaaggcgaggaagaattcgctggacgcggagtttcatattgtgcagtttgtgatggcgcctttttccgcaacaaacggttgatcgtagttggtggtggagattctgcagtcgaagaagcgatctacttaacacaatttgcttcagaagtaacgattgtccaccgtcgggatgagctacgtgcgcaaaagatcatccaagaacgagcatttgccaatgaaaagatctcatttatttgggattctgtcgtggaagaaatcaaaggcaacgagatggtcgtaactggtgttcaagtgcgaaatgtcaaaacaaatgaagtaacggaagaagcggctggtggtgtctttatctacgttgggctagatccattgactgaaccattcagagctagtggactcacgaatgaaacaggttggatcccaaccaatgaaatgatggaaacaactatgccaggcgtctatgcggtaggggatgttcgagaaaaaggcttacgacaaatcactacagcagtcggggacggcagtatcgctggccaacaagtatttgattttatagaaacacaaaaagaccagcaaccagttaaataattatcgaacgcactgttatttataaaacgttattcgtttttgatagcagtgcgtttgcattttcgtttggttattctttgagaaaaacagaagtagtgttatactaaaattatagtcattttaaagttagaaggagtggtttttgtatgggatgggaacaaatttatgagcaatggaaaaatcatcaacaattagaagcagggttgaaggatcagttaacagaactggagaaagatccagaaatgttgcaagatgctttttatatgccgcttgaatttggtactgctgggatgcgagggatcttaggacctgggatcaaccgcatgaatatctatacggtccgtcaagcaacagagggattggcgcgcttcatggatacacaagatccagaaacccgtcgccgcggtgtcgcaatcgcatatgattctcgtcatttttcaccagaatttgcgatggaagcagccaagacattagcaaaacacgatattcctgcctttgtgtttgaaagcttacgtccaacccctgaattatcttttgcggtacgttatctgcatacgttcactggaatcatgattacagcatctcacaatccggcagcttataatggatacaaagtatacggcgaagatggtggacaaatgcctccagcagatgcggacgccttgacagcttttgttcgagaaattgaaaatccattagaaattccagttttatcagaagaagaagcaaagcatagtggattgatcacgattatcggcgaagaggtcgatactgcgtatctaaaagaagtcaaaacagtgacaatcgatcaaaaattaatcgagacaacagggaaaaatcttaaattagtttacacaccattacacggaacaggtcggatgcttggtgaaaaagctttgaaacaagcagggtttgagcaatttattattgaaccttcacaagctgttgcggatccaaacttcagtacagtcaagtcaccaaatccagaagaacattctgcctttgaatatgcgattgctctgggagaaaaagaagacgcagacttgttgattgcaactgatccggatgcggatcgcttgggtgctgcagtccggatgcctgatggaaactatcaagtattgacaggaaatcaattaggcgcattgatgatccgttacattctagaagcccacaagaatgccggcacactaccggaaaatgcagcagtcctaaaatcgatcgtttctagtgaattgccaacagcgattgcccagtcttacgacgttgaaatggtcaatgtattgactggcttcaaattcattgccgaaaaaatccaacagtatgaaacagatcattcccatacgttcatgtttggttttgaagaaagttacggttacttggtaaaaccttttgtgagagataaagatgcgatccaagcacttgtcttgttggctgaagtcgctgctttttataaacaatcggacaaaacactttatgatggattgcaagatatctttgaggaatatggttattatgccgaaaaaacgatttctgttacgatgagcggtatggaaggtgcagccaaaatcactgcattgatgaaaacattccgagaaaaagcaccatcagttttcgtgggtataccagtcgttcaaacagaagatttcaaagaattgacaagagttggtttagatggtcacatgcaaaaaatgactacaccaccgtcagatgtattgaaatatactcttgaagatgagagctggattgcggttcgtccttctggaactgaaccaaaaatcaaattttacattggtgtcaaaggaaactcttctgaagatgcagcaaataaaattgctgaacttgaagctgccattaatgaaattacagaagtttaagcgataaacaagagctagatccttttcaaatacttggatgagaatcagatagattattttgctgatattcagttcttcttggagaacttattataggaaaatgtgctgcttcttttccaggtatttgggtggatcctgcatttattttgacgccttgttttcaatggggcttgacaaagaatgcttgaaccagctagaattttattcaccatcaagaaaggaagaccagcatgactcaaccagatcaagaagatatccaaaaagtcactcaaatttttaaaatgcttggtgatcctacacgtttgaagatattgctttctttagaagaaggagaacgtaatgtaacttcgatcgcagagcaagtgatgatggaacaatctgcggtctctcatcaattgaaactattgaaagataatcggatcgtaaaatcggaacgacaaggaaagacaattttatatagtttagatgacaagcacgtagtcgacatcttacaaaaaacattcgctcatatccatcaccgctgaaactaggacgagaatttctcgaaagccctagttttttcttatgctttttggtatgctagtagaaaattaaaaatggatgaacgattttttaataacgttttcggtaaggaggctatatgaaagagcaattaaatataggactactaggaatgggtgtcgtaggcactggagtctgccaactattagcggaacaaagagaggcaatcgcagcccgaactggtgtcgagatttttattacgaaagcattggcctctccttatgatgataaaagcgcaattgcccaaaaatacgggtttgaactgactagtgatattcaggaaatctatcaggatgagtccatcgatgtcattgtggaattgattggcaagatcgatcctgcgaaggattttattcttggtgcgttagctcacaagaaacatgttgtaaccgccaataaagatctcttggcgtctcatggcccagaactgactgccgctgctaaaaaagccggtgttgcattgtattatgaagccagcgtgggaggcgggattcctatcttgcgaacattaagcacgcattatttacccgatacgattacctcgatttctggcatcgtcaatggtacgacgaattatatgctgacaaaaatgttaacagataacttaagttatgaggaagttctagctgaagcacaggcaaaaggatttgcagaatcggacccgaccaatgatgtggacggtattgatgcagcttataagatggtcctcttgacaaaatttgcatttggtatgacgatcgagatgaaagatgtttctatcggcggcattcgtggattagcaattgaagacatcatttatgcccaacaactagggtatgaagtgaaacttattggtacggcacaaaagacaccaaaaaatcatgtcgctgtttctgttggtccagttcttgtccctaagccccatccgctagcctcaatcaaatatgagtttaatggcgtgtatatcgaaagtacgggcatcgatcgttccatgctttacgggcctggagcgggggctcgtcctactgcgacgagtgtgctggcagatgtgacggagatcgctaaaaataaatctgctgggatcactgaatcatttctaacctttgaacagccgactcagattgcagtaccagatgagcttcgtcaacgttattacattgcgttgactggaccattagcagcgcagcaacagacattggactggatcgaccaagaatctatcttggaaaagaaagcatttttgacgaagccattgagtccctcggaattaacagcagcattatcgatttttgaagatggtcgaattagccaaatcatgaaagtaatggaggagtagcagatgtatgaaggactattaaagcactataaagagtatttaccggtgacagaaaaaacaccgctaatctcattagcagaaggaaacacaccgctgattccattgaataacttatcaaaagaattgggtatcacattatatgggaaatacgaaggactaaatcctactggatctttcaaagatcggggaatggtgatggcagtagccaaagcggtggaagaaggcgcaaaagcaatcgtttgtgcttctactggtaataccagtgctgcagcagcagcgtatgcgacacgagcaggaatcaaagcctatgtggtgattccagatggtaagatcgcaatgggcaagttggcacaggcaatcgtttatggcgcggatattatttctattcccgggaatttcgatgaagcactaaaagcagttagagaaattgccaaaacagaagctgtggccctcgtgaattcagtcaatccttatcgtttggaaggacaaaaaaccgctgccttcgaaatttgccagcagttggagaaagcgccagatgtactagcaattccagtaggaaatgctggaaacatctctgcttattggaaaggattcaaagaatggcatgacaaacaagggacttcactaccaagaatgcatggatttgaggcagaaggtgccgcagcaatcgtaaaaggcgcggtaatcgaagagccagaaacaatcgcaacagcgattcggatcggcaatccagcaagttggaagctagcagaagccgctcgtgatgaatcaaaagggtttatcgatgctgtaaccgacgaagagatcttgaatgcttaccgaaaggtagctgcacaagacggtgtctttattgaaccaggatcggctgcttcactagcaggcgtgattcagcacgtgaaaaacgggaaaattcgtcctggtgaaaccgtagtggcagtctttactggaaacggcttgaaagatcctgatacagctattcaggctaccgaagtagcgatccataagatgagtgatctagaagaaatgcggcaacacctgcgtaaaggagtgtctcaactatgaagattcgcgttcctgcaaccagtgcaaatttaggacctggttttgattcttgcgggattgctctctcaaaatatctattcattgaaattatggaagaaagtgaccgatgggagatcttacatgaactcggcagtgaaatccctaatgatgaaagtaatctgctgttacgtgtcgcgctgaagcttgcacctacacttacaccgcgtaaaatccgcatgtactcagatatacctttagcacggggattaggcagcagttcatcggttatcgtggctggaatcgaattagccaatcgtttaggacacctgaacttaagtgatgcacagaaagttgatattgcaacggccattgaaggccaccccgacaatgtggcaccggcaatttatggcgattttctgattacggcctttgatcatgaacataaacaaacttatgttgttaaacatcattttccggaatgcaatattgttgcttatattccgcaagaacaattgttgacagaagctagtcggaatgtcctccctaaaacactggacttttcaactgctgttgaagccagtgcaatcgccaatgtgatgatcgcagcagtgatcaaagggaatctacctttagcaggtaaaatgatgcaggcggatcgttttcatgagaactatcgtgaaaaattaattccgcatttatccacgatccgccaaatttgtgaagaagaaggcggctatggctgcttcctgagtggggctggaccaactgtcttagcgattgtcccacccgaaaaggcagataagatctgccgccttctccatgcgcttgaaaccaatgcagcaatcgaacagctgcagatcgatcgcgaaggcgtccaagtcttttagacttttctgatttgacacaagcaaaaatccccagaataatggtacagtctagctgaccattactctggggatctttttgtctaaaatgtatgtggctggttattcttctgtttctgacgtgtagtaactatggtcttccaaattcaatgcattcaaaatcatggaagctgtctcttcaattgaaagagaggcaacattaatgacgatgcagcctaatttttgataaagatcattggcaaactctaattcagcccggattttttcaatatctgaatacgccgtgtctggattcaatccgtaagaacgcatccgttctttgcgtatgctgtttaaaacgtcgggatcattcgttaacccaacgattttgctcggttcgatttcccacaactgcttaggaatatgtgcttggggcacaagaggcaaattcgccaccttcaagtttttgttggctaagaaaagacttagcggtgtttttgatgttcgggaaacacctaacaaaacgacatcggcttcgagaaaacctcgtgggtcttttccatcatcgtatttaacagcgaattccattgctttgatacgtttgaaataatttttgtttaaatgatgcaatgcgccgggttctcgcgacggagcgacacctgtgcgtttttctacctcggtgacaggaggagtcaatacatcaaaatgatacaggtcggcttcttcacaaaagtgattggttagcgagactagctcatcgttaatcagtgtgtgcaaaataatggcatcgtgttttttggcatcagtcaacgcctggatcaagtgttctttggtgtgaataaaggtacgccgaaataagttgaattcaacacttgggtactgtgccatggttgcttgagctaatttggaggccgtttctcctgctgaatcggacaagacaaaaatcgtgacaatcgtttcttgtgggttcatagtaaaatcctctcttgcatttttgataatttcattataccatacttacgatcgctaaaaatcggaatgattttgatttactggagggattcgatgaaaaatcaaccattgattgagcaagctatgtcgatattaaaagaacatggctataaatataccaaaaaaagagaagctatcattacttatttagtgaaacgcaaccgttatttgccggcaaaagaaatccatgatttcatgtctgaagaatacccgggtctaagttatgacacgatctatcggaaccttcatgatttttctgagattggcatcttggaagagactgaattgaatggagaaatgaaatttcgttataattgctgcgtggaattggaagatcatcaccatcatcattttatttgcacggtttgtggcaaaacaaaagagctgcatatttgtccaatggatttctttcaagaacaattgcccgggtgcagtatcgaaggccatcgttttgaaattctaggcagatgtgaagattgtcgctgattgttcggattctaagattgaatcaggaagttcatcgacttttttactagaataccttgacactttttcaggggttagctataattttcaaaggacagtcttgttttttgagattttatttcaatgacaaatacggttactttttaagctcggagggagggaatttacatgtcaaaaacagtcgttcgcaaaaacgaatcacttgacgatgctcttcgtcgcttcaaacgttccgtgtcaaaagcgggtactttacaggaatctcgtaaacgtgaattttacgaaaaaccaagtgtaaagcgtaagaaaaaatctgaagcagctagaaaacgtaaaaaattctaattttctactgttttgagaattggagctggtagtgtgacgctactaagtacactgaatgatgacatgaaaacagcgatgaaagccaaagacaaggaaacgttgcaggtgattcgcatgttgaaagcatcgattcaaaacgaacagatcaaaaaaggtgccgacttgaacgaagaggaagaattgactgtgttgtctcgtgaaatgaaacaacgtcgtgattctctgactgaatttgagaaagccgaccgtaccgatctggctgaaaaagtcaaaggtgaaattgcaattgttgaaaaatacttgccggcacaacttgatgaagcggaaattcgccaaatcgttgctggtgcgatcgaaaaaacaggagcttcttctccgaaggaattcggaaaagtgatgggcgctgtgatgcctcaagtaaaaggcaaagcagacggcaaccaagtcaatgcgatcgtcaaagaattattagggcaaatgtaaggacacgccgtaagcatcttattggatgcttacggcttttttgttctttcttagtgagtatttttaagtagaatcaatgatcgaaaaacaaacttttaataaattgcaaagaacgctgccaaaacgcttcttgaagcttacaagtaattttgcttttagcgattgtgtggtattataaactagaatgcctaaaaaaggagctgtaacttatttgacagaagagcgtatttctttggaaatccaactgactcaaaatgatgatattagtttgttgttgggttcccatgacaaacatatcaaagtcatcgaagatgctacacaaacaacgattcatacccgcggagaaatgatccaaatcattggtgaaaagacagccgctgaaaaagcccaatccgtgatccatgcgttgcaagagttgatcaaacgagggatcaatatcagtacgccagatgttattacggcattgaacatggcaaataaaggaaacttagattatttcacagatatgtatgaagaagaaatcatcaaagatcgtaacggtaagccgatccgcgcaaaaaatgccggacaaaagaaatatattgaagccatcagaacccatgatgtcgtttttggcgttggaccagcaggaaccggaaagacgtttcttgccgttgtcatggccattgcggcattgaagaaaggacaagttcaaaaaatcatcttgacgcgacccgctgttgaagcaggtgaaaatcttggctttttaccaggtgatctgaaagaaaaagtcgatccctatttgcgtcccgtttatgatgccctttatcaaatctttggtatggatcataccaatcgtttgatggaacgcggcgtgatcgagattgctccgctagcctatatgagggggcggactttggaagatgcttttgtgattcttgatgaggcacagaataccactattgcccaaatgaaaatgtttttgacccgcctaggatttaattcaaaaatgatcgttaatggcgatacaagtcaaattgatttaccaaaaggaacaacgagcggactgattcatgcgcaacgagcgttagaagcaattcctaaaattgcgtttgcgcactttgaagcaggagatgtcgttcgtcatccagtcgttgcagacattatacgtgcctatgaggaatccgatagtaaagaacaacgttgattgtcggacaggaggggtaaaatgatcatacaaccgttacggaattttcgagaaaaattaggccgcttttacctgccgctgcttatggtgctcttttttgttttatctattgggatcatgttttccagtgtaaaacaaaacaatgtcgactatagcgaggggcaggttgcggaagaaaatatccgagccaacaaaacgattgaaaacacaactgctactgaacaaaaacgtacgctagccgctgaagccgtctcgcctgaatacacgtatcaagacgatttggcacaagttcaacatgaacggatcaatcatttgtttgaattgattgatacagtcaacaagactgtcaatacgaaatatgaagctgcggtcaaagctgctggtgaaaatgaaaatgttcctaaaccggatacagaagagtatatcgccactttaaaaaaagaatttgaaaaaatgagtgatgatgaacttgatttttatcaagcgctgaccaataattttttgtcgacattgttttcattgaatagtgatcagctgaacacggtaagagattatgcgctgcagcttgttgatgaacaaatggctaaacagatccgccaatctgaattgagtacttttcgatcagaagccgaagaaaagatccagtttttggatgtaacttctgaaatggcaacagcattacgctttttagtcaatcaagggatcgttgtcaacgattttcctaatgagaaacgaacggaagaagctcggcaggctgccaaagacgctgttcagcctgttatgatctatcaaggtgagatcattgtccgggaaggctcgcagattgattcaaatgcattagaaaaattgcagcttctcggtctgacgagtcaaaccttctctgtatttccgttgattgctttagtttttactgctgctttacagatgctcatgctcttttattacacacggcagacaaaaaacgaagacaaacggatgaatgctgtgaccttttatgtcattgcgatgatttttagtattttattgatgaagtttttccaactatttcagtctgaactcatcgcgttcattccgttattctttccagctgcctttaccccgctgatcttgaatatattctcaagtcggcgtttgggaattttagctgcgatgtttcaagtaatcaatgcgattttcatttattttgattccagcggtacgaatatgctgactactgtcttggtaacctatttgttctctggattgatgggaacgatgatcagaagggaacgaatcgccagtcaaggacgaacagccattatgtgggtcatcgtctttccgttcttattaagtgtcatgttagtgattttccaagggatggatttcgcgagaggcaatacctggacgacgatcatttgtgccttagcgggttcattacttagctatctactaacgattggtttgcatcaatacattgagttattggtctcagacaatagcatgatcgttctgaacgaactaagtaatccaaatcacccgttacttaaacaattactggaagaagcaccaggaacctatcatcatagtatgatggtcgccaatttgagtgctaatgctgtagcagagatcggcggacaaagtttactgacacgggtcgcttgttactatcatgatattggtaaattaaagcatgcgaatttctttgttgagaatttacccgcaggggctgaaaatccccataactttttgcttccggaagacagcaagcagatcattttcggacatgtgatcgatggagcggttcttttagaaaatgagaaaatgcctcagatggtggtggatatttgtcgccagcaccatggaacaaccttgatgcgttatttctatgtcaaagcgaaagaacgtaatccagaagtgacagaagccgattttcgctatcctggaccaaaaccacaaacaagagaagcaggggtcgttagtatcgcggatagttgtgaagctgctgtgcgggcaatggataatcccacagatcagaaaatcaaggaatttgtttcgaatttgatcaatgatcggattcttgatggacaattagatgagtccggactgacattgcatgaaattcgtatcattgaaaagtccttagtcaatggattgtgtagtacattccattcacggatcaaatatccgaaaatgaagtccgaagcggaaaaaatgaaagaagaacaagaaagaagagatcggtaatggagattgcttttttagatgaaacaaatacagtgagtcaagagaaaatcaatgaaattgatgaactgctgcagtatgcggcagactatttgaagctgcctgaggatacggaaatgtctgtcaccttcatggacaatgccgctatccaagtcatcaatcgggactatcgtgataaagatcaaccgacggatgtcatcagttttgctttggaagaagaaacggaagaagagttgccgatcatctttgatgatgaaatgccagctatgccgagaaatcttggggatatcatgatttcagtcgagcgggcaaaagagcaagctagtgagtatggacacagctatgatcgggaattgggctttttagcgctgcatggatttttgcatatcaatggttatgatcatatgacaccagaagatgagaaagaaatgttcggtctgcaaaaggaaatattggatgcctatggactcaaaagataagaatacagaaaaaaacaaacaatttatcacatccattgaatttgcctttacaggaatcaagaccgtctttgacgaagagcgcaatatgcgcaaacatgtcttgttaggcatcgttgcaatcattgcgggatttgtctttagattaaatcaaatggaatggctctggttgttgttgtcggtatttttggtttggatcgtggaaatcgtcaacacagtctttgaaaatgtcgttgatatgtttaccgattttcacttccatcccattggcaaaaaaatcaaagacatggcggcaggagcagtcctgatgacagcattctttgcattgatcgttgcggcaattatttttataccaaaaattttagcgttcttttagaaagataatacacagaggagatcacctatgacaacacataaatcaggctttgctgccattgttggccggcccaacgttggtaaatccacattacttaatcgagtagtaggtcaaaaaatcgctatcatgagcgacaaagcacaaacgacccgaaataaaatccaaggggtttacacaacaccagatgcacaaatcgtttttatcgatacacctggaatccataagccaaaacatcgcttaggagatttcatggtggaaactgcttatagtgcacttcgtgaagtcgatgtgaccttatttatgatcagtgccgatcaaaaacgggggaagggcgatgacttcattatcgagcggctgcggaaaaacgagacgccggtctttctagtcatcaataaaatcgataaagtacatccagacgaacttttagctattatcgaagattatgcggctcaaatgacgtttgcggagatcgtgccgatttcggcaacggaaggaaataattttgagacattgatgagattagtcattgatcaaatgccggaaggtccccaatattttcctgaggatcaaatcacagaccatccagaatatttcatcgtttcggaattagtgcgggaaaaagtgctgttactgactagagacgaagtgcctcactcagtcgctgtggtggttgactcgatgaaacgggatgaaaatgataaaattcatattcaagcaacgatcgtcgttgaacgggatagccaaaaaggaatcattattgggaaaggcggcaaaatgctgaaacaaatcggaacaaaagcacgattagatatcgagcatttgttagacgataaagtttacttggaattatgggtcaaagttcaaaaagactggcgagacaaacaaaccttcctgacagactacggttatcggaacgatgattactgatcttctctaaacaagatcagctaagaagtttgatgagagaaaagacaaagaaagctggagcaagcgaaggggattgagctgcttcagctttctggtttagaaaggagcgttgttcatgaatttagttgaaacaaaagggatcttgttatttactagggaccataaagaaaatgataaactggtcaaaatattcactgaatcggctggaaagcaaatgttctatgtaaaaggtgcccaccgcaagaataatcctttaacgccagctttgctttcgtacactgaagcgacctatattggaaatattcgttctgagggcttgtcattcttgaataatgccaaagatatccattcttttcgcaaaatccaaggtgatatttttcttgcaggctatgctacgtatctattgaatctggctgactctgcgatcgatgaccgcgtgtacgatccaaatctctatcatttcttacatgaagctttgcagttgatggatactgataatgatgcagagatcatcactaatatttttgagattcagttgctgcagcgttttggggtctcaccgatatggacccactgtgcggtctgcggacaaacagaaggccgctttgattactcctcgaaatacaatggcgtcatatgcgaaaagcattgggcattagatgaccatcgttatcacggtgatccaagggcaatccattttattcgtttgtttgcacaaatctcttatgaacaaatcgcatcgatcaagttaaaaccagaaacgaagcaagccattcgtcaggtaattgatttattgtatgatgaatatgttggcttacatttgaaaagcaaaaaatttattgatcaaatgggacagtggcaagatatcctgaaacccaaagatcaacgataaagttggcgaaacttctttggagtagcgccaactttttttttgaaaagagcagtgaaatgacttgcatctgggattcctaccaagaaagcgacatcttggatatccagatgaggctcgcctaccaataattctttggcacgattcaggcgataattcagcaaaaattggaaggttgactgccccaaaaagcgctgaaagagacgcgacaaatactgcggagttacaaaaattttttccgcaagttcagcgacggtcaatggatgagcataattggtttcgatttctagtagtacaggcgcaatgtagcgttggtacaaatgatgcttttcatttgcgtcagcattttgttgttggatcaatgccaaaagaaagtgatagcaactgctggaagagcgcaatgggtctaatattttttcttgatcgtcgctgattcgttgattgatccactcactgtaagaaaataaagggctatcttgccccatcaagtagcgctttccgccaaaaggtttcaacagttcctgtactaaatctccttgcagcgtaacaaagtttgtctgccagtctctatgaggatggtaacgatgagggatgaatggcaaaatcaaaatgccagccccaggagttaacacaaaggattgatcgttaaaaaggacggtcccttggccagcggtagtttgcaaccagtgataatatggataaccagtggggcgaaccacttcatcttgtgcccaatgattcccaatgctctcgatactgacagggagccgagggttgttctgatagaaatagatagacattgaattctccttgtttcgaaatattatagaatcatgacaatcctattatactacaactttttgaaaagccttacaataataattatcaatgagaaaaaggagcgtcaaacatgaaaaaagtttttgaacggtttttattcggtggcgattataaccctaatcagtggccgcaagaaatctggcaagaagatatgcgaatttttagaaatgcacacatcaatagtgcaactatcaatgtcttttcttgggcaaaaatccaaccttcagagcacgattattactttaatgagttggatgagatgattgatatgttgagtgaagaaggctacgacattgtattagcgacttcaacagcggcgttgccagcatggatgttcaagcgctatccagaagtggctcgaactgactatgaagggaggcaccataaatttggacagcggcacaatgcgtgtcctaacagcttagtctaccaaaaatatgcacaacgattagctgggaaattggcacaacgctatgttggtaacccgcaagtcacttgttggcatatcaataatgaatatggaggtgagtgttattgcgaaaactgtgagaaagcttttcgggtctggctaaaagataagtatcaaacccttgaggcattgaataaagcgtggaatctggaattttgggggcatactgtttatgaatgggacgaaatcgttctgccgaatgctctttctgaaggaatcggtcatgacaaaaccgcatttgcaggaatttctatcgattatcgtcgtttcaattctgacagtcttttagaaaactttaagttagaacggaatgctattcgtcaattcgatagtcaaacaccgattaccacgaatttgatgggaacttttaaaggactcgattacttcaaatgggcaaaagaaatggatattgtttcttgggacaactatccttcgtataatacaccatggagtttcgttgcaatgactcatgatttgatgcggggattgaagcaagcgccatttatgttgatggaacaaacaccatcccaacaaaactggcaaccatataattcattgaaaaaacctggccaaatgcgcgcgcaaagctatcagacgatcgctcatggagcagatacaatccagtttttccaacttcgccgctccattggtgcttgtgagaagtttcatggtgcggtgatagaacatgttgggcatgagaacacccgtgtatttaaagaaactgcagcattaggagaagaattgagccgactgaacgaagttttgggtagtgaaacaaaggctgaagttggtgttctatttgattgggataattattgggcattggaatatacgagcggaccaacagttgatttgacttatgtgcaacaaatccatcaatattatcgttacttttatgaaaagaatatcgcaaccgatttggtgtcagttgatgcagatttcagcaagtaccaagtgctggtagcaccggttttgtacatggtaaaagcaggtatgaaagaagctcttgaatcctttgtggaacaaggaggcaccttgatcacaacgtatatgagtggcattgttgaccagtcagacaatgtccatctaggcggctaccctgggcctttaagagagctagcaggaatctgggtagaagagattgatgcattagcaccagagcagacgaacgttattcaattaaaggggggaagacagggagaaagtaacttagtcagtgagatcatccatttggagaccgctgaatctgtagcggactatacgagtaacttctatgccggttcaccagcagtgaccaaaaatcgatttggtcaaggtgtcgtttattatattgggactcaacttgaaaaagatcttttagatacgatcttggatgaagcaaccaatagcgcaaatctaactgctgtgattgaaggagaaacaaatctagaaatcagctgtcgtcatacggaagaagcggtttactattttatcatcaattttcagaagcaagcgcaaaaggtgccggcacaatttgtaggaaagaaggacctactgtccggtaagcatttgactgaagactccgttgcagatcaatacagtgtatatgtaatcaaggaaggaagaagcgaatgactgcttttgtaatcaaagacgaattttatttaaatgatcagcccatgaaaattatttctggctcgatacactattttcgagttgtgcctgcatattggcgggatcgcttagaaaaattacgtttgatgggttgtaatacagtcgaaacgtatgtgccttggaatatgcatgaaccgcaggaaggaaagtttgactttagcgataatcttgatttgcggcgctttattcagcttgcacaggaggtagggctgtatgtgatccttcgtccagcaccttatatttgtgcggaatgggaattcgggggccttccttattggctgttaaaagatcccttcatgaagattcgctttgactatccaccgtttatggaaaagatcgctcgatactttacacagcttttttctcaagtgagtgatttacagatcactcaagaaggaccaattttgatgatgcaagttgaaaatgaatatggcagttatggaaatgacaaaagttatttgcgaaagtctgctgaactaatgcgtcacaatggcattgacgtgcccttatttacgtcagatggtccttggctggatatgttagagaacggttcgatcaaggacatcgcactgccaaccatcaactgtggatcagacattcaggagaattttagaaaacttcaagaattccatgggaagaagcagccattgatggtcatggaattttggataggctggtttgatgcatggggagatgacaagcaccataccacatcggtaaccgacgctgctaatgaattgcgggactgcttagaagctggctccgtcaatatttatatgttccatggtggcacgaacttcggctttatgaatggtgccaactattatgagaaattatcaccagacgttactagctatgactatgatgcgttgttatcggaatggggcgatgtgacacctaagtatgaagcatttcaacaagtcataggtgaaattaccgaaatcccatcctttcctttgactacaaaaatcaccaaacgggcttatggtagctggaaagttagtcagcgagtttctctctttgagacactagctagcatcagtcaaccagtcaagcacaattatcctttaacgatggaactgttagatcaagctactggctatgtctattatcgttcgcaaattggcaaatcgcgtgtgatcgaagactatcgactgatccattgtcaggatcgagcccatacgtttattaataatcagctgcaatttattcaatatgatcaggaaatcggacaaaagaagactctcacactgacggaggagtcaaatgagttagggatcttggttgagaacatgggacgggtcaattactccgtccaaatgaatcatcaatacaaaggtatcaaagacggagtgatcgtcaacggtgcgtttcaaagtgaatgggaaatatacagtctaccgatggataatcttgatcaagtagatttttccggtcactggcaaacgggacaaccgagtttctccaaagtgagctttcaagtggatgaatgcgcagatacatttgtagaactgccgggctggggcaaaggatttattatgatcaatgggcataatattggtcgtttctgggagagaggaccgcaaagacggttatatattccagctccttatttacgagaaggaaacaacgaggctgtgatttttgaaagtgacggtcgggtatcagatatgatcatctttcacgatcagccggacttaggccctaattaattgcttttatattttttgattgacaaagtccctatacagctactatgataaggataatcaaataaatacgttgatcggaaaaaagaaagaagccagagtcatccagcgagcttgggatagtgaaagccaagttgaatccttttttcgcaggcatccgggagtatgactcaatgaagctgccgagtaatcggaagtagggtggaaccgcgagaatatcgtccctatatctatgcgcaagtataggtatagggattttttggtgtgattcaccattgctcgaatcactgtgatcgacctgtaaaacaggacatacaagtccttgttagcgaaccctgctggtagaagtgactgcaggagtaacacagaagagacgagcagatgtgaaacagtaggctcgcagggagaacgtagtacctgtgtcctatttcatgaaaaactcaacctttgcggtagaatcaatgacttagaaaaggaggggactctcatgccatttgatatgacgattgctgcatcagaattcaaagaaaaaaaattaaaagtgttagcaagtattccattgcaaatcttagtcaagcaagatgaccaactagtcaaagagttaacaacaaaaccggaccaaatgttgtatgatttgtcagatgttttgacggatgaccatgttgttgaagtaaaattgattccaggtcatgttgttgaattttatccagtagtcaatgcgttgtaagaaaggaagaaaataatgagtaaattaaccgttcaagaaatgatcttgactttacagaagttctggtctgataacggctgtatgctaatgcaggcgtatgataccgaaaaaggagcaggaaccatgagtccgtatacttttttacgtgcaattggaccggagccttggaacgccgcctatgtggagccgtctcgccgaccggctgacggccgttatggagaaaatcccaaccgtttgtatcagcaccatcaatttcaagtggtgatgaagccctctccagaaaatattcaagaattataccttgaaagtctgcgtttgctagggatcgatccgctagaacatgatattcgctttgtagaagacaactgggaaaatccttctatgggttgtgctggtctgggttgggaagtttggctagacggcatggagatcactcagtttacttacttccaacaagttggaggattggcctgcaaacccgttacttcagagatcacctatggactagaacgtttagcatcttatatccaagaagttgaaagtgtctatgatctggaatggtcgacaggggtcaaatacggcgagattttccgtcagcctgaatttgaacattcaaaatattcctttgaagtcagcgatcaagagttattgttaagcaattttggccgctttgaggcagaggcaaaacgctgtatcgatgaaaacctcgttcatcctgcatatgactatattttgaaatgcagtcatacatttaacctgttagacgctcgaggagctgtttcggtaactgaacgtgctggatatttggctcgtatccgtaatttagcacgacaagttgccaagttatttgtcgctgaacgggaaaaactaggttatccattattagcaccagaagaagcggaaaaattgattgcgggagggaaataaaatggcacaaaacctattattagaaatcggtttagaagaaatgccagcacatgttgtcacgccaagcatgaaacagctacaacaaaaaacggcggagtttttgacagctcatgcactgcaattcagttcgatcgaagcttattctacacctcgacgtttagctgtatatgtgactgggattccggaaagtcaagctgatacgcaagaagaagtgaaaggacctgccaaaaaaattgcaatcgatgccgatggcaattggtcaaaagcagcccaagggttcgttcgtggacaaggattgaccacagatgcaattaccttcaaagaattaaatggtgtggagtatgtctatgtcaccaagcatattcaaggtaaaccagcgcttgaagttttaactggtttgaaagaggtcattactagtttggtgttcccagtaacaatgcactgggcaaatttcgattttgagtatatccggccaatccactggatcgtagcattgtttggcgctgaagtcgtaccatttacagtccttgacgtagtaacagatcggaaatcccgtggccatcgtttccttggagaagaagtcacctttgaaactgccgatgactatttgagtcaaatggaacgccaattcgtgatcgctgatccatccaaaagacagcaattgatcgtagaccaaattgaggcaattgctaaagaaaacaactggcggatcgatcttgatgaagatcttttagaagaagtgaacaacttggtagaatatccgactgcttttgtcggtgactttgatgaaaaatatctttcagttccagaagaagtcttagtcacttcgatgaaagaacatcagcggtattttgatgtgcgcaccccagaaggtgttttgttgccccatttcatttcagcaagaaacggcgatcgggtaaaaatcgataatgtagtcaaaggaaatcagaaagtattgacagcgcgtctagaagacgcggaattcttttacaatgaggataagaaacttaccatcgatcaatgtgtggagaaactaaaacaagtcactttccacgaaaaaatcggtagcttatatgaaaaaatgcaacgggtagctgttattgctcaaatcattggagaaaccgtcgaattgtctgaagatgaaagaacagaattgaaacgtgcatcagaaatctataagtttgatttagtaacgaatatggtcggtgagtttccggaattacaaggagtcatgggtgaaaagtatgctctcttgcaaggagaaacaccgcaagtggcacaagcgatccgtgaacattatatgcctgtctctgctgaaggtgcgttacctgaatcaagcgttggagcaattttagcaattgctgataagttagacagtttactgtcattctttgcagtgggcatgattccaagcggatcgaacgatccatacgcattgcgccgacaaacttatggcatcattcggattattgctgagaaacgttggtacttcccgttagcccgtttacaggaaaaaatccgcacagcaatcaatgaacagccatcagtctatggcattcaattgaacgaaggacaagagcaagtcattgattttgttgacggacgtctgcgtcaattcttagcaacgaaaaacattcgtcatgatgtgatcgaagcagtgatcaactctcgtcaaggcgatatcagtcttttgtttgaagctgctcaaatgttgagagcacatttgaatgattctgatttcaaaccttcgatggaagctttgacaagggtcattaatcttgcaaaaaaggcagatcttgaacacaaacaaatcaatcctgaattgtttgagaacgaatcagaaaatacgctttatgaggcagtggtcgccattgaagataagttcccgcaacaaacgatggaacaaaactatcaaagcctagtttcattgagaccattaatcgaagcttattttgatcagacaatggtcatggtagatgacgaggcaatacgtcgcaatcgttttgcattattggataagatcgccaaaatgagtttggcagtagccagccttgatgctttagtcacaaaataagatttgatccagctagtgtccaacaatgtgtgtttggatactagctgaattcctaaaaaagcctagccatcttcatttacttgaagatggctaggctttttatatacgcgtcaatttaacgacaacttcacaacgagcagtttgaggaaacatgtcaacagactgtaaatactcaatcttgaagacagacgctaatttgaccaaatcacgggctaatgttgaaacattacaagagatataaaccattttctttgggggctgagcaactaacgcttgcaacaggtggtcatctaatccagttcgagggggatcaaccacaatactgtcgggtctaaaaccagcagcaaaccatttagggagtaagtcttcagcagttcctgtttcataatgcgtattatttgcttggattcggcgggcattttctttggcattttcgattgcttgcggaatgatgtccatcccacggacttcctttgcatgttttgcgaggcttagtccaatcgttccaacaccacaataggcatcaacgacggtttcattttttgtcaatgccagtgctttgattgcttcgtcataaagtatactagtttgttgcggattcagttggaagaatgcacgaggtgaaaggtcgaatgttaattcctgcaatcgttcttcaatcgcttcttttccccagagatgtaaagtttcatcccccatgatcaccgaggtcttcttgttttggacattttgcatgatcgaaactacttgaggcatgcgttgattgatttctcgaatcaacgcatttttctgtggcagtttgctagagttcgtgataaaaacgacttgtacttcgccggtcgctctgcccactctgaccatcaaagtcctcaggatgccgctgttttttctttcatcatagattgggagttgatacttgttcagtaactgcacaaggccattgatcacatcttgggttgctttttcttgaacgagacaatcatcgatcgccactaaacgatgagaatccatttcgtaaagaccagcttcgattcgttttgattttgtatcatatcgcaactgaaattgcgctttgttgcgatagtgccatggttcttccatgccaatcgtatcttttaagatatacttctgataacctttgggcttaaatttggttaatgcttgttttaataagtctttcttaaagtctagctgcttttcataaacaagatgctgtaattgacagcccccacaacgatcataaaatttgcagggggggagaatacggtcgctgcttttcttgatgattttggtcattctcgcttctgcaaacctcggagttgctttggtcacttctgcaatcacttcttctcccggaagaactcgcgggacaaagacgatcaattttttataatagccgattccttctccgttgattcctaaacgtttgatcgtcagttgtagtttttgaccgtttttaagttgtacgtttgccatgattgctccttatcgataaatagtctctctattttaccatactttttatagctcttttgaaggaatttccccttttttgtgataaactagaatatacgttcgtgaggtgaagaaaatgataacgatcattcgtatcagtaagggaaaaggtcccttttacgaagtagactgctccaatggagaatctttgcgggtttctgaggatcttctggttcgtttccgtcttctaaaaggaaaagaagtgacggaagaagagttgaccgaaatcaaaaaaagctccggttttgatattgggctgcagcaagcaatgaattacattagctatcaactacgttccgaaaaagaagttcgtacctatctaaaagacaaagaaatcaatttagaggatcgccatttggtcgtgcagcgattgaaagaactaaatttacttgatgaccgtacctacggagaaagctacttgcggacacaaatccgtttaggagacaaagggccatcagtcatcagtcagcaactaaaacaaaaagggctgtctgaagaagtgattcaagaagtgatgccgttatatacagaagaaaagcaatttgatgtcggctatcatactgccgaaaaagcattgcgtcggttccaagggaaaagtcacaaagagatgatgcagaaactatcgctgcacctaatgcaaaaagggtttagacaaccagttatccaattaattttagatgaactgcctacagatagaggcgacgaagaggaaaacgcagctttgcaaaaagagggtcaacgacttttgcgaagacatcagcggttgcctttgaataaaagaaaaatgaaaatcaaacaaggtctttaccaaaaaggtttcgctctggatgcgatccaacaatttttagatgaggaagttatggatgaataaacagtgggaaaagtggtcaaaagaggacattcgttctttccaagacaagtttttgaattggtaccatgatgaaaaaaggaatctcccttggagagcaaccaacgatccctatgcaatctggatctcggagatcatgctccagcaaacaagagtggacaccgtcattggctattattaccgctttatggaacaatttccaaccatcaaagatttagctggtgcagaagagcagaagcttttgaaggcttgggaaggattaggttattactctcgtgcacgcaatttaaaagctgccgctcaacaaatcatggcagagttcgatggagagatgccacagaccatcactgatattcgttcgttaaaggggattggtccttacactgccggggcgatcggcagtatcgcttttggattgccggaacctgcaattgatggcaatgtgatgcgtgtagtgagtcgtttgttttgtattgaggcagatatagctaaagcaagttctcgcggagtctttgataaagcaatgcgtacaatcatttctcacgatgagccaggagaattcaatcaagctttgatggatcttggttcaagtatttgtacgccgacttcgccattatgcgaggaatgtccactgcaagaatattgtctagcctatcagcagggaacacaaaccgactttcccgtaaaatcaaaaaaagcgaagccaaaagatatgtattacattgctggagctattgaagaagatggccgctttttattggtgcagcgaccagaaactggcttgttagccaaaatgtggcattttccgcttttggaagtggatcaggcgacctatatgcaattattggcttattggcaagaccaacagttaacattggatgcagttgcagaagaaccagctccgattttccctgaatttcccgtcgtttggcaaaaaagacatcttggtgaggttactcacatctttagtcatttgaaatggcacatactgcttttttatggacgcacaccgtcggaattctcgttagaacacagtcaatgggctgcgccagaagaatttgaacagtatgtctttcccaaacctcagttgaaattagtcgaacaattgaagaaaaatcataaagtcgataaacatttctaggcaaagggttgttttattgctataatatttacgatatcggtgtaatgaacacccaaacaaaacgcaagttttcttgctgagggaagggttgctatgcgagttccaaaagaaggagagtttgtcagcatccaaagctacaaacatgacggcaatttgcatcgaacgtggcgggatactatggtcttaaagacgagcgaattctcaatgattggtgtcaatgatcatacattggtgactgaatcggatggaagacgctgggttacccgtgagccagctattgtatattttcataaaaaatactggtttaatgtaatcgcaatgatccgagaaaagggggtttcctattattgtaatctcgcttcaccgtatttgcttgatgaagaggccttgaaatatattgattatgaccttgatatcaaagtatttcctgatggtgagaaacgtttactagatgtggatgaatatgagcttcatagcaagatcatgcattatccgcaggacattgattttattttaaaagaaaatgtcaaaattttagtagattggatcaataatggcaaaggaccattttctgaggggtatgtggacatttggtatgatcgctacaagcagttgtctcagaaatagcaaggagtagccgtaaagggtcacttcaatgtgcaaaagactcgactttaattcgaagtcgagtctttttgtatcaaaaaatagtgcctgtcatcgagtgattgatttgtaaggcggggcttctttaaaggagattcatccagttctataaagaagcgaaagttgtcaatcacgtgagttataagtgattgacagcttttaagatacttagttctgcagatatttactcattttgatgtggggcatatccgcatcaagaaattcttccccttcaggttggtagcctagagaaagataaaaaccttttgcggttagctgagcacctaaagtgattttttgaaacccttgtttccgagcaaaatcctccgccccttggatcaaaattcgtccgaagccttttttgcgatgggaaacgggtacggccatacgctgaagtttcaatgtgtggctatctataggaagcagccgcaaagttgctgttgcttctttttgttcattgtagagaacaaaatggaccgcgtttgcttcgtcctgatcgatctcaagacttaagggcacgccttgttctttgacgaagacatcattacgaattttcaacgagtccagataaatttcgcttaatgtatctttggtttgtgcgacgaacataaaatcaaccaccttcttatttcatcaattattttctaagtataccatttttacgaaaagaaaaattgcttttgcggctaaagtcgcaagcttttttttgcaaaatactctataatagtgaaaaaaaggagggaatcgtttgttcgacaaattcaaacaatcaaaacttttcttctggtcattagaaattctcgttcttgccacgttagctctggtattgagcaaaatcaatttcttatttgcaccagtaggaacatttttttcgacattatttgcgccggtcttaattgcaggctttttgtactatctgcttaatccgatcgtcgtttttctgatgaagaccactaagatcaaaagaatctacgctgtgattttagttttactcttattagtagcagctattgtcctaacagtcgtaagcgtgattccaaatctgatcaaccaaatttcacaacttgcagaaaatattcctacttttgctaaaaatatggagacttggatttctaaaatagcagatgacccagtatttaaacagatcgactttgcgcaacagttagaaaatctcaatctttcctatggttcattgctgcaacaatttctaagtgggctgtcaacaagtttgggatcgatcgtaggaacgattgcttcagcaacgatgatcattgttacagtaccattcatcttgttttatatgctgaaagacggcgagaaacttgtgccaaatattcaatcagttttacctgaaaaaagacgaaatcaaatcatcgagttattgggtgatctgaataaaacattgtccaattacattagcggacaagcgattgaatgtatttttgtcgcgacctttacctttatcggctactggctagtgggtgtcaattacgcctttttatttggtgtcattgcagggatcactaacttgattccttatttgggcccttacctcggcttgattccggcagttttagtgacaatctttgatgatcctttccgggctctgttatgtggtgtagtcgtgttagtcgttcaacaattagatggtaatgtgatctatcctaatgtaatcggaaagtcattggcgattcatccgctaaccattattttagtgttgctagtcgcagggaacatcgctggattactgggtattttcttaggagtacctttctacgccatttgtcgtacgattgtgatttttgtgattcgtttgattcgtgacgataaaagcaagaaaaaccaagagaaattgatcgaactagataactgatggtttttattgcaaagaaaaaagctttatgatacgattttatcgtgggtatagcccacgattttttttagaaaatgtaaaaataaggagagaatgctattatgaatgctgaccccgagagtcagtcgctattagcgcaaattttattattgatcgttttgacattgatcaatgctttcttggctgcttcagaaatcgcggttgtttcagttaataagaaccgtgtagaacagaaggctgaggaaggaaatgtcaaatcacaaaaattattgaaaatcattgacaatcccaccaacttcttgtcgacgatccaagttgggatcacattagtcaatatcttatcaggggcctcactggcagatacgctatctacccgcttagcacccgttctaggtggcggagctgcagcaaaaagcctggctaatatcattgtattagcgattttgacctatgtttcgatcgtatttggtgagttgtatccaaaacgaatcgcaatgaacaaatctgaagaagttgctcaatttacttcaggtgtgatacgtgtgattggtacgatcgcaaaaccatttgtgtggttgctttccgcttcaactagtttgttagctcgaatcacaccaatggaatttgatgatgaagatacaaaaatgactcgtgatgaaatgcggtatatgttagaaacagaaggtgtctttgaagaagatgaattggaaatgctacaaggaatcttttcattggatacgaaggtggcccgtgaagtgatggtgccgcggactactgcatttatggtcgatatcaatgattcagtagatgaaattttgacagaaattttagcagaaaactattctcgaatcccagtatataatgaggacaaagacaaagtcgtaggtattttacatacaaaaaacctgctgaaatgtgcctataaatatggatttgaaacattagatattaaacaaatcctccaagaaccattatttgtgcctgaaactgtttttattgatgacttactctatgagttgaaaaagactcaaaatcagatggctatcttattagacgaatacggcggtgtcgtaggtctggttactttagaagacctcttagaggaaatcgttggtgagatcgacgatgaatcggatgaagtagaagaattatatgaacaagtttctgatcatgagtacatcatccaagggcgaatgttgattgatgactttaatgaagcatttgatatgagcctgcacatgagtgatgttgatacaatggccggatatttgatcacagctttagggttgattcctgatgaaggagagaaattatcctttaaagtggataacgtcacactgattacagaagaaatggaagggtcacgtgtattgaagatccgcgttatcttccatgatcctgaagaaacagctgtcgaacctgaagaagaacgccgctatttcaaaaaagattttgaagaagacgaacctcgtcgataaaatgaatgcttgaagcaaatgcttcaagcatttttttgtctaaaaataatatataacagaatgagttaatcaaatgatacagatttagctagataaaaaaactaaaataactaagcatatttcttgcttttcttgtgaattaaagagagtataagagtgcgataactagaaatcattgtggggtgggaaaatgagattttaccgaatgaaaagtgatgatattcggatgaacttagctactgaagaatatttaatgaataacgtagatatttcagaaccatgcttgctgttatacatacaaaagccttgtgttataatcggtagaaaccaaaatgcctacgaagaaataaattttgactatttacgacataatgacatcgttttaacccggagaacctctggtggcggagcagtttatgacgatctaggcaacatgagttttagctttgtgactaaaaaagatgtgactcattttggtgattatcatggagccacccaacctattttgaaagcattgcagaagatgggagcaaaagaggttgaagtacggggaagaaatgacttgtttgttgaaggaaagaaattttctggtaacgccatgtacacaaaaaatgacagaagctattcccacggaacattgatgttcgatgttgacttaagcgttttgacaaaagtgttgaacgttccacaggaaaagatcgactcgaaggcaacaaagtcagtgcgtaaaagtgtgaccaacatcaagccttatctttctgaagaatatcaacaattgtcaacgaaagaatttagagatcaattgctctgtcatatttatgacgtcgacaacattgaggaaatccaagaaaaagaaatcaaattaacggctgaagatcaacggaagattaatcagttgtatcaattgcgatatgccaatgatcaatggatttatggggaagccccgaattatcaatggacgaaacgcaaacgttttgaaaatgttggtatcgttgaactacgcttttcagtggcaaaggggaaaatcacagaagcacaaatcactggagatttttttggcgaagaagatatcgctggtctcgaaaaacagctgattggtcttccttataatgaagagttgcggcagcattttcaagggatggaagtcgcgaaatatatccatcaactgacaaatgagcaatttgtatcactacttttcaattgagtttgaaggcagaggagcgtcaggaaccaaatatgatcgaagtaaaagaggtttcacaagtatatcaggacaatgtccttgatcgagtatcgttaacaatcagcaatgagatcgtcggtatcgtcggcaaaagcggttccgggaagtctaccttgttgcgtctgattaatttgatcgaatctccttcagctggcgaaatcgtgattgatggcgtgaacacgacaggattgaccaagaaaatgagacgaagtctacagcaagatattgcgatgatctttcaacaatttaatctgctccataatctgactgtctacgacaatgtttttttgcctttaaaattagctggaaaatcacaacgacaagtgatggaaacgttagacttcgtaggtatgtctgaaaaggcttcggtttatcctgcttctttaagtggaggggaaaagcaacgagtagcaattgcccgtgctttggtcaaagaaccaaagatcctcttgtgtgatgaaccgaccagtgcattggatgaagatactaagggagatgttttatcgttattgcaaaaggttcatggcactttccagcctacaatcgtgtttgttagtcatgaattgtcagcggttcgacaagtttgtgagcgggtctatgttatggaacaaggaagaatcgtagcggaagtagcgaatacgccgcatcttttacaaaaagaagaattaaactatgtcgatcgtgtgataaggagtctaaagcatgacgataattgagagtattcaatactatttaccagaattgatgcaggcgatggaagaaaccctgatcatgatgagtatctctatcttcgccgctgttttgattggattgccattaggtattctattatttattagtcgtgaaaacaacaatcagggaacgattttgtatcaaatattaaatttgctgatcacggtcattcgttcgtttccttatttactgtttgttgttgcgatgattcccgtcactcgttttttgttaggcagctcgtttgggccgatcccagcaagtatcccattgagtattgtgtcaatcgtcatctatgctcgtttagtcgagcaggtattgttggatgtcccagaagatgtcggactattggcacgctcattaggtgtctccacttatcaatatgtcaaagaatttttgcttgtggaagcaagaagcgggttaatcctgtctctgacgacaacgatcgtcagtatggtgtcttattccacagtgatgggaatcgttggcggaggaggaatcggagactttgccatccgttatggatatcaacggtacgaatatggggtcatgtatttttccattttagtgatgatcgtagcagtttttagtattcagttgattgggaatgggttagcaaaaaaagttgataaaagaaagtaggagtaggaatgaaaaaaggaatattttttgggttagtactagcagtaatgtttcttggtgcttgtggaacagggaatgagtcgcaatcagaggataaagtgattaaagtcgcttctcaaacgacccctatgacagatgttgtcaaagtagcagccgatgcggtagaagatggctggaaaattgaattggtacaagtaaatgacaatattcaatacaatgagctgttgaataataaggaagtagacgcaaactttgcgcagcatgagccgtatatgcaacgctacaatgaggaaaaatcagcagatttagtggctttagacaaaatttataatgctaaagtgggcttttactcaaaagagtatacaaaaattgaagacattcctgaaggaacgaaagttgctctgccgaatgatgtttctaatgaaggacgagcattagccatcttagctgagcaaggattgattgaattaaaagatggagttggagtcaatggtacgatcaaagacattactgcgaatcctaaaaactttgaatggttgtctgtggacttattgaatctagcagaagcctataatgaaccaaatgtctcccttgtctacaactatccgacctatatcgccaaaattggtctaaagcctgacgatgccttgttcttagagaaaacgatagatgatcgttttgcgatctctttagttgctcgtaaggacaatcaagattcagaaaaaatcaatgttttgcgaaaagcgatgaccagcgataaagtcaaagaatttttggaaaatgagcatagtgatacattaattccagccttttagttttttgagtgtttttcatgctttcacagcagttctcgtataaatacaaatagctatcaagctgcttaaacagttgctctctagactttcgaatctgaatgatagagagcatttgtctgtaatttttcttttttccgctcttgatacatgatatactgatttggtcagaaaatctttgtatagacacagagagttctaatttcaaggaatggagtaactacataacatggagaatccaaatttaaaacaacaagttgaaagtcgtcgcacctttgcgattatttctcacccggatgctgggaagacaacgatcactgagcagttgctgctatttgggggagcaattcgccaagcaggaactgtcaaaggaaagaaaaccggtaattttgctaaatccgactggatggaaatcgagaaacaacgggggatttctgtcactagttctgtaatgcaatttgattatcaaggaaaacgtgtgaacattttggatacaccaggacatgaggatttctctgaagatacgtatcgtacgttaatggctgttgatagcgccgtgatggttattgatagtgccaaagggatcgaagcacagacgaaaaagcttttccaagtcgtaaaaaaacggggaatcccgatctttaccttcatcaacaaattagaccgtgatggtcgtgaaccattagaacttttagaagagctagaagagttgcttcaaatcgagtcctacccaatgaattggccaatcggaatgggaaaagggcttgaaggactttatgacattcacaatcaacgggttgaaatttatcgtccagaatctcatggcggtgaacgcctgattccatttaatcaaaacggtgaaattccccaagatcatccgctgaatcaaaatggtgtctatcaacaagtgttggaagaagtcgaattattacaagaagctggcgattcctttgatgaagagaaaatcgctcgtggtgatcaaacccctgtcttttttggctctgcgttaacaaactttggtgtgcaaactttcttagaaacatttttacaatttgcaccagcaccttacggacataagacaaggacaggagaagaaattagtccatacgaacaagagctttcaggatttgttttcaaaatccaagccaatatgaaccccgcacaccgtgaccggattgcctttgtccgcatttgctcaggaacatttgaacggggaatggatgtcacgcttgagcggacaggcaaaaaaatgaaattaagtaatgtgacccagttcatggcagacactcgcgaaaatattgagcaagctgttgccggcgacatcattggggtatatgataccggaaattatcaaattggtgatactttatatgaagggaaattgaaagtcgcctatgaagaattaccttcgtttacacctgaactctttatgaaagtaacagccaaaaatgttatgaaacaaaaatcattccataaagggatctatcagttagtgcaagaaggagccatccaattgtataaaacgtatctcagtgatgaatacattattggagcggttggacagctgcaattcgaagtatttcaatatcgaatgctgaacgagtacaatgcagaggtgatcatgtcgccaatgggacataagattgctcgttggatcgatcctaaagatttggatgaaaagatgagttcaagtcgcaacatcttagccaaagaccgtttcgaccagccattgttcttgtttgagaaccaattcgcgatgcgttggttcgccgacaaatatccagatgtcgaattgaaaagtttgatgtgaaaacactgctagtacttgtgacggcaagtgttctcaaatgatgggagcgagaaatgagttggttcttgtctaaaaaaacattcttatcgtttttgataagaatgtttttttgttttgtatcagtaaaaaatcgaattgttttggtctaaaaaaactgatataataatttatgacgtgagacgagcgcttatagtgttgcaaataggagtaagggggtcattatgaaattaatcaagcgtgtcaatttgcttgacgataaaaagctaatcatgaaactgaatatcttaacgattcctctattggttattttctttgctttatttacgcttttaacattagatagaaagttaacggaagaagtcactatcgatttaatgtatctcgttattgccattctatcaatggcagggttaatcatcgttcacgaattgattcacgggattttttttaagctgttcaataaggaaggaaaagtcaaatttggttttaagaatggtttggcctatgcaacaagtcctaattccttttattcaaggtggcagtttttacttattttgcttgctccttttgtcttgatcactttggtcttatggctgttgtatgcgtatagggaaatttctccttatgcatttgtctggttggcttcttttcatgggtcagcctgtattggggatttttatttttgttatttagtgactaaagctccagcgcatagttatgtagaagataccgaacaggggataaatttttattccaatcattagcaaagcacagccattagggctgtgcttttttgcactcatttgaaaaacgtttttgttgcgtagcatggctatcatttgtcaatcactttgctatagagcatgcactgaagatcaatttttttgttgggcaattttaatgaaatctttttttctttttgacgttgaaaaccgcgcttttcataaaattgatacgtacaagcactatctgtaaaaagataaatttcttttccttgcactcttttctgtagttcatttagcagccgcgttccgagccctttgataggtatatcaggattagctgctaagaaaatgattttcccatccggtgaatggtcacttaaatattcagaaaggagttgattgtttccggcatcatatgctccggcactttctttggcaaaactattctgtaagaattcaaatagtttgaagtagttactgtaaatgtcacagaaggagcagcaacatttactttagctactcctgttgaaacaaaaactgtagattttgcagatattagtttcacagaaacgaaagcgaatccgctaacaggtactttcacgttatctggaacattaacgaataagtcatttggagcaaagcaagtagtgataacagcagcagttcctggagaaacctcagcacctggtttaacgattgcaacgagtgaagtattcaaagttgaagcaagtcaaggctatgaaacgactgaagaaggtacttttgattatacaattgatccttcaacttttgacaacactaaggcaagtgattacgtaatcacactaactgcatcagaagtgacagacgtcactccttaatcgtatgttatatcctagctacaagaatgaatcttattcttttagggtgtttcttttgttcctgtgcttaggaatattttttttcagtccagaagcattggccgaagaatcgattggctcttcttttgaagttcagatccaagcagacaagaattcaagtatagtaaaagatattcaattttcgcctgatctgaaccaaaagtatacttatacagcaactgttactaatcatgaaagtcatgccattgaagtatcggtttttcctagtatcgctgtttcaactaggacttcaatgacttatgttgcggaaacaaacaatttgctaaataaagattatgatttaaagaagtacgtaaaactcttaccaattgaaggtaaattggagagagtgtaaaatattttgtgtaaatagaaaaaaggaagtcccttctgtagaatagagttaccacaacacattcacagaagagaggacttccctatgaacgattttactacagaaattctaaagactctagcgaacaaaggcgatttgaatgaattattccgtgtccatttggagaaagcagtcaatacgcttctcaaaacggagttaacggctttcctagattacgaaaagtatgatcgcattggttttaacacgggtaattctcgtaacggctcctatgaccgtacggtcaagaccnnnnnnnncgcccccccgtggcgaggtgggggtcgcgggttcgaaccccgttttccgcttttgccatcgcaatcagccggggtggcggaactggcagacgcacaggacttaaaatcctgcggtgagtgatcaccgtaccggttcgattccggtcctcggcatttcttaatatgcgcccatagctcaattggatagagtgtttgactacggatcaaaaggttaggggttcgactcctcttgggcgcgttttagcaacgggaagtagctcagcttggtagagcacttggtttgggaccaaggggtcgcaggttcgaatcctgtcttcccgattatattttcaaaaggggccttagctcagctgggagagcgcctgctttgcacgcaggaggtcagcggttcgatcccgctaggctccatatcatttgaataaatgattttttcgcggtgtagctcagctggctagagcgtccggttcatacccgggaggtcgggggttcgatcccctccgccgcgattattaagagcctggacctttagctcagttggttagagcagacggctcataaccgtccggtcgtaggttcgagtcctacaaggtccattgtggcattgtatatgttggaggattacccaagtccggctgaagggaacggtcttgaaaaccgtcaggcgggtaaaaccgtgcaagggttcgaatcccttatcctcctttactgaactcttgatcggattgtagatcaatgagtccagcttttaattacttaaagcagctattgtaattagtaatttattatcgcgggatggagcagtctggtagctcgtcgggctcataacccgaaggtcgtaggttcaaatcctgctcccgcaattgcttctgttaatacaatagaagcgtcaaataaaaactaaaatatggtttggtagttcagttggttagaatgcctgcctgtcacgcaggaggtcgcgggttcgagtcccgtccagaccgccatgcgggtgtagtttagtggtaaaaccacagccttccaagctgttgtcgcgagttcgattctcgtcacccgctttagtttttattttttgggcctatagctcagctggttagagcgcacgcctgataagcgtgaggtcgatggttcgagtccatttaggcccattgaactatatattttgttacatttggggaagtactcaagtggctgaagaggcgcccctgctaagggtgtaggtcgggaaaccggcgcgagggttcaaatccctccttctccgttttagcggtccgttggtcaagtggttaagacaccgccctttcacggcggtaacacgggttcgagtcccgtacggatcattgcaacactttttggaggattacccaagtccggctgaagggaacggtcttgaaaaccgtcaggcgggtaaaaccgtgcaagggttcgaatcccttatcctcctttactgaactcttgatcggattgtagatcaatgagtccagcttttaattacttaaagcagctattgtaattagtaatttattatcgcgggatggagcagtctggtagctcgtcgggctcataacccgaaggtcgtaggttcaaatcctgctcccgcaatcaaaaaaactaaatatggttccgtggtgtaggggttaacatgcctgcctgtcacgcaggagatcgcgggttcgattcccgtcggaaccgttatggctcggtagctcagttggtagagcaatggattgaagctccatgtgtcggcagttcgattctgtcccgcgccatcttgcgggtgtagtttagtggtaaaaccacagccttccaagctgttgtcgcgagttcgattctcgtcacccgctttagtttttttattttgggcctatagctcagctggttagagcgcacgcctgataagcgtgaggtcgatggttcgagtccatttaggcccattgaattttacttggtccgttggtcaagtggttaagacaccgccctttcacggcggtaacacgggttcgaatcccgtacggatcatgaaagcatcctttggaatgctttttttttatgttttaaaaaaggcaattttaaaagtttttccataaattaggcacagtaggtcaaaatttgttataatcagtccgttgcaagttcccgaaaggattcgcagctgcgaagatgccttgtaaccgaatcgaaatttagggggaatacaaaaaatgacagagaaacatttatttacttcagaatctgtatctgaaggacatccagataaagtggctgatcaaatcagtgatgctattttagatgcgctgcttgctgaagatccaatggcacgggttgcctgcgaaacctcggtgacgaccggattagtattggtctttggcgaaatctcgacaagtgcctatgtagatattcaaaaaattgttcgcgaaaccatcaaaggaatcggttatacacgggcaaaattcggctttgacggtgacactgtggcggtattggtagccattgatgaacaatcacctgatattgctcaaggcgttgacaatgcattagaagtacgcgatgaagcgaatgaagaagaaatcggtgccggagatcaaggattgatgtttggttttgctgttgatgaaacaccagaattgatgccattaccaattgcattgagtcaccgtcttgttcggcgattagcagaactgcgtaaaacgaatgaattgacctatttgcgtcctgacgcaaaatcccaagtaactgtcgagtatgatgatcaagatcagcctcgtcgagtggatacagttgttatcagcacacagcatgatgatgcagtagacaatgaaacgattcgtcatgacgttattgaaaaagtgattaaagaagtgataccagcttctcttttagacgatgaaacaaaatattatatcaatccgacaggacgatttgtcatcggtgggcctcaaggggatgccggattgactggtagaaaaatcatcgtagatacttatggtggatatgcaagacatggcggtggcgcattttctgggaaagatgcaacaaaagttgaccgttctgctagttatgctgcacgctatattgctaaaaatatcgttgcagcgaaacttgcccgaaaggtagaggttcagctagcttatgcgattggtgtagcacaacctgtatcgattcgaattgatacgtttggaaccggaaaagtcagtcaagagaaattgatccaagctgtaagagagaattttgatctgcggccagctggaattatagaaatgttgaatctacgtcgtccgatttatcgtcagacagcggcatatggacattttggtcgtacagatatcgacttgccatgggaacaaacagataaagtggatgctttattggcaagtgtgaaggaataaagaggcgacctctgttgatgtaaatcaatagaggttcttttttttgacttagaagagggggagaatgatgaaaacgaatgtgacacgtgtgacgattgctgtttttgttgcaacatttatgacggctatcgaagggacgatcattacgactgctatgccgacgatcgttggttctttacacgggatcgagatcatgaattgggttttttcgatttacttattgactagtgctatgttgacacccatttacggtaaacttgccgataccattggtcgtaaaccgatttttttatttgggacactgctctttatgattggttccgcactctgtggcttgtcaaacagcatgctgacactcatcctttcgagagctgttcaaggaatcggggctggtgcgatgatgcctgttgcattgacgatcatcgccgacttgtaccctgtagaaaagagagcgaaagtcttgggtttgaacagtactgcttgggggattgctagtgtcgtcggtccattagctggtggtgtgattgttgatacagtcggttggcactggatcttttttattaatgtgccgattggtgtgtttcttcttggcatgatttggttttattttcatgaaaacaaaaagacgaagaaatctgagaaaatggatttacttggtagttttttgatgatggtcacattagtttctctgcttttagggtttcagttactaggcgatcaggggttaagtgttgctgtggtaagcttactgattttgactattgtaacattcctgctgttttatcgagtagagaaaaaagcagcagatccattaattgatttagcgttattccattctagaacttttgtggtagtaaatattgtcgcagcactagctagcggttttttgatgggtatcgatgtgtatatcccaatgtggatgcaaggagtcttaggaatgagtgcaggtatcggtggtcttgtactagcaccgttatcgattttatggatggtcggctcatttctagccagccgctggttgctgaagcggtcggtttcatgggtcctaacggctagtctattaattacgcttgttggcgcaatctggctttttattaccccaatgaaaacgtcttttctctggtttttaggaatctcttcaattaccggaatcggattgggagcgacgatggtcgtttgtaccgtgactgctcaaaccagtgttcctcattcacaaattggggtagcgacctccttcaatacgctattaagaacaattggtcagacaatcatggtttctgttttcgggatcgtcttgaatatcagcaataattttggattgaaagaagcaggtattcaagatcaggaaatcatgaatcgcttagtggacccaactgctgctaagaaactttcaacagacattctgcttcaattacgaggaattttgtacgatggattacattgggtatatggattaggattgttgctgattgtgcttgctttggtgtttgcccgtacaattcggcgagaatctggtacaatgataaaaaaagaatcgcaggtgatttgatggcttttatacaagcaaatatctattcaaatgttcttgaaatggaagtaatggtaaacgtgattctcccccaaactaccatcaaaaaggtaggtacaactacaaaaaatgatcaaaaagaattaccagttctatatctattacatggaatgggcggtaatcatagtgtctgggaaagacgaacttcgatcgagcgctatgtgagcgactatcaaatggcagtgatcatgccttcgactgatttggcttggtatacagatacaacttatgatatgaagtactggacctttgttgcagaagagttaccgcaaatctgccgagagctgtttcctcaattgagcagtgatcgagagaagacatttgctgctggtctatctatggggggctatggtgctgttaagttgggtttgcgtaaaccagagagttttgctgccgttgcctctttgtccggggctttagcgattgctgaaagcatggattctcttttaaagattcgaaatacttcttactgggaagggatttttggcccattggatcagtttcaaggttcagagaatgatttgatccatttgatcgatacgattgatccgcaaaaggcaccgcgcttttatattagttgtggaacagaagaccaactgtttcctgcaagtgaatatgcagttgcaaaaatgcaggaacgtgacttggcagtgacatttgagtctggttccggagatcacgattggcaattttgggatcagtggatccaacgggtattaaactggctcgttgaaggaaaataaaaaacatcagagaccgaagaatagtcaacggttctctgatgttttttttcgttcgatacaaaacaggactggtggttggttgcgctgattgatgaattgataggacagcacgttaaattgcgcttgtggtaattgacgacaaaagcgatgaacagcttctaactcttcaggtccgccttcgtggccataatagcatacaaggatgatccgaccgcaaggaacaatacgttggatcaatgcttgcagtgcctgttcggtcgtctcaggtaaagtaatgatttttttatcgctctttggtaagtaacctagattgaaaatagctgcatgaacggcatcagggacgtaatccgctactgtttcatgtccttggtggatcagttcaacttgcggcaggagtccttttgctaacaagcgttcttttgttgttgttactgcttgttcctgaatatcaaaggcatagactttgccttcaggtccgactagtgttgccaacagctcggtatcatggccatttcccatggtggcatcaactacggtctgtcccggtttgacgacttcttgtaaaagggtgtggctataacgcatggctgtttgtagcatagatagcctcttttctaacatcaaattttccttgataggagtcgcggcgcaacatttctttatcgatctcattcaagacttcccattttttgagactccacataggtccaatcaaagcatcccaaggagcgtcacctgtcagacgatgaatgatgatctccgcaggaatcatttctagttggtcgcaaatcaaagagacataagtctctctttgcatcaattgcagcttgccttcatgatagtcccggagcatgcgggtatttcgcatcaaatgcaagagatggagtttgatcccttgaatatctgagtccaagattgttttccgcacattttcccgcatcatttctaatgtttcaccagggagtccattgatcaaatgggtacaaacctgaatgccatgttttctcaatttagcgacaccatcaagatatgtttgataatcatgcgcacggttgattgcgttgctggtggtttcaaaggttgtttgtaaccctaactccacccacaaataaaagcgttggttcaattcagctagatagtctaccacatcgtctggaagacagtcaggacgtgtaccgatagaaacaccaacgacacctggcatggtcaaaacttgttcaaaccgctctcgaatgactgcagctggggcatgggtattggtgaaattttggaaataaacgatgtacttatcgacatgaggccattttttgtgcatcacatcgatttctttatgaaattgaacgggcagcggggcttcaggtgcaacgatcatgtcgcctgaaccagatacgctgcaaaaggtacaaccaccttttgcaacagtaccatctcgattgggacagtcgaagccagcatcgatcggtactttaaatattttttcaccaaattcctgacgcaatgcataattccaagaatggtaacgtttatgctgattttcggcataggggaatgaattcatggattttaccttcttttcttttttctaagattgtttttgttggaaacgccagacaaaacgcttttctaaatagtacggataggtcagtaacagccaagagagtcccacacaaaatccgccgagtacgtcgctaggaaagtgaacacctagatagatccgactgataccgatcagaaaaatcagtaagccaagcaagattctcataccccagcgtaacgcttgtgactggaaaaagacaggaatcagcaaaagtaaggttccataaaataccatgctgccagtggagtgtccgctaggaaaactagagcttgtctccaacactaaatgttccagtgtaggtctttctcgcataaagaataatttaatcaacggattgaagaccgctgagatgccaatcgtaccgaaactgagccacagtgcttcggaatagaagcgattgataagcaacacgaccaatacaacaatgaaaagcagtccaatcgttactggattagcaaacttggtcacccataggaaaaagtcagtcaaaaaaggataaccgctacggatcaaacgagtgctactttcatcgaaaggattcagccaagttggatagaatttgacaacatagcctaaaaaggcaaaaagcagcaaaaaacagctgccggcgaattgataatacagttttttgttcataaaaaaatcctcatttctacaggcaaacatagtgagtctattataccatttatcttggagggacaaaagacagtggtgcaggggtgtttcttgagggacaatattgtataacaagaaattgtcgcttacttcttctttcgaataatgtacgttagattacaaagagtttacagtttggcgaaaagaaggaaataacttttataaaatcttaagaaattgtatactaaacgtaggaaaaaaatagaagacggaggaacgttcatgaacatgagtttatcgcgcaaagagcgtcgcagagaaggacagtccagtgaattttatcaaacgatgagaaaaagtgccgctgttgtagggacaaccataaccgcttgctcagtagtagcgcctttgctgactccagttcaagcggatgccgtagaaaatactgtggtgagaagtaactttgctgcacctaatacagcagcattcattacagaaatcgcaacttatgcacagcctgttgcccaagcaaatgatctttatgcttcagtcatgatcgcacaagccattcttgaaagcggctggggaagaagtgccctgtcccaatcacctaaccataatctttttggaatcaagggcagtcataatggtcagacagtctatatgaatacagcagagtatttaaacaatcaatggttgactatgaaagaacccttcaaaaaatacccttcttacaaagaatcttttgaagacaacgcacgaacattaagaaatgtttcgctaggaaacggtaattattattatgcaggtgcttggaagagcaatacgtcttcttaccgtgatgcaacccaatggttgacggggcgttacgcaacagctcccaactatgcttcttcattgaatacggtgatccagcagtatggcttgactaaatatgatacaccagcttcaggcaatgccggtggtggagcaacggtcagtacgcctaataccgctacaaatcctgtcagcaagccagcagcgacatcgtcagtttcttctggtagtcaaggctatacagttgcgtcaggggattctgtctggggaatcgctaataaattcggcatcacaatggatcagctatgtagctggaacaatattcgcaataattttatctacccaggacaaaaactgacgatcaatggtggtactgccaaacaaacgacgaatacagggaccatatctaccacgacagcaagtgctggtagttatactgttgcttcaggggactcggtttggagtgtggcgaacaagcatagtatcacgatggaccaattgcgcaactggaacaatatcaaaaatgactttatttatcctggtcaacacttagtcgtaaaaaatgatactgggtcaaaaagtcaggccaacaagactacagcaataagttctgtaaccaatgctggtagttataccgttgcttcaggggactcggtttggagtgtggcgaataagcatggcatcacgatggatcaattgcgcagctggaacaatatcaaaaatgactttatttatcctggtcaacgcttagtcgtaaaaaattctggaaataaacagacaagtagcccgaccacagcttctacgagcatttcttcatcagctggcagtcaaaagtatacagtggcgtctggggactcggtttggtcgattgctaataaatttggtatcacgatggaccaattccgcagttggaacaatatcaaaaatgattacgtctatcctggtcaaagcgtacgggtcagcggtacggcaacggctgcgaatcagacggcaagtacgagcaactataccgtagtatctggcgattctgtctggggaattgcggataaatttggtatttccagagatcaatttattcaatggaataacattaaagacaactttgtttatcctggccaaagcgttcgcgtaaaatagattgctattccgctgtttttttgataggataagtgcaaagaatctttcacatttgagaaggaatagtagaaacgtgttggaatcaagagagtgcatggctggtggaaatgcacagaagacctttcgaactcgccttcaagtgatatttgactgaaatgagtgtttctcagaaccgctcaaagtaggcagatacggcgatggtcgttaacacatcgaggtctgtttcataacagataaaattaggtggtaccacgtttataacgtcctataaaaatcaatagtgatttttataggacttttttttaagttctgctgatttttgatcaagtcagagcaccaatttttaggaggcgtccatagtgaactacaatcacaaagaaattgaaaaaaaatggcaaaaatattgggctaagaaaaatgagttcaatacccacgatcaaccggataaaccaaagttttatgcgttagacatgttcccatacccttctggacaaggattgcacgtagggcatccagaaggatatacagcgacggatattctaagccgcttcaagcgcagccaaggattcaacgttcttcatcccatgggttgggatgcttttgggttgcctgctgaacaatatgcattggataccgggaatgatccggccgagtttacgaaaaaaaatattgaaacattccgtcgtcaaatcaattcactggggtttagttacgattggaatcgtgagatcaacacgacagatcctgagtactataaatggacgcaatggatttttaccaaactttatgaaaaaggattggcttatgaagccgaggttcctgtcaattgggttccagagttaggaacggttatcgccaatgaagaagtgatcgatggcaaaagtgaacgcggcggctacgatgttattcgcaaacctatgcgtcagtggatgttgaagatcacggcttatgcggatcgcttgctagatgatctagaagaagttgattggcctgagagcatcaaagaaatgcagcggaattggatcggtcgttctgtgggtgccaatgtcaccttcaaagtagcgggtagcgatgcagcattcaccgtctttacgacacgaccagatacattgttcggtgccacttatacggttttggctcctgaacatgagttggtacaagccatcactacaccggagcaaaaagcagcggttgaggcatatgttgcagaaacagcgaagaagtccgatttgaatcggaccgatttgtctaaagaaaagacgggtgtcttcacaggggcctatgcggtcaatccagcgaatgggaaagaagtgccaatttggattgctgactatgtgttggcttcatatggtactggtgcgatcatggctgtgccagctcatgacgaacgtgaccatgaatttgcaaaagcttttgggttagaaatcattcctgttctggctggaggagacgttgaagaagctgcttatactgaagacggtcctcatatcaattcagagtttctggatggtctagataaagaagcagcaattgaaaaaatgaaccactggttagaagaacaaggagtcggtaaaaaagaaatcagctaccgtctgcgagactggctgttttctcggcagcgttactggggtgagcctatcccgatcattcattgggaagacggtactacaaccactcttccggaagatcaattgccactacgcttgccaaaaaccgataatatcaagccaagtggtacaggtgaatcgccattggcgaatgtcagcgagtgggtcaatgtcgttgatccagaaacaggcatgaagggacgtcgtgaaacgaatacgatgccacaatgggcggggagctcttggtacttcttgcggtttatcgaccctcacaataaaaatcgcttagccgattttgacaaattgaaacgctggttaccagtagatatctatatcggtggggcagaacatgcggtgcttcatttactttatgctcgtttctggcataagttcctttatgatcttggtgtcgtaccgacaaaagaaccattccagaaattattcaatcaagggatgatccttggggaaaacaatgaaaaaatgtcgaagtctcgcggaaacgtcgtaaatccggatgatgtcatcgaacaatacggagcagatacactgcgcatgtatgaaatgttcatgggtccattagatgcatcgatcgcatggaatgaaaacggcttggaaggcagccgtaaattcctagaccgcgtctggcgtttgatcgtggatgaaaatggcaaaatgcgtgatcgaattactacattcaatgatggcaaactaagtaaagtttacaaccaaacagttaaaaaagttaccgaagattttgaacagcttcatttcaacacggctatttcacagctgatggtctttgtgaacgaagcatataagtccgatgcactaccatatgaatatgttgctggatttgtccaattgttggcaccgattgcccctcatatcggtgaagaactatgggcaattctcggaaataaagagggcatctcttatgtgccatggccaacttatgatgaaagtgcgctagtcgaagatgaaatcgaagtggtattccaagtgaacggcaaagttcgggcaaaagccaaagttcctgcggatgcagacaaagcgacgctcgaacagttagctcaatcaaatgaactggtaaaagaacaattgaatggaaaaacgattcgcaaaatcatcgttgtaccaaataaattagtcaatatcgtcgctaattaattgaaaagagggactgtgccataagtctcctacaagtaaaactctccgaacattaactattattgctcctgcggtgcagggactcctcgtcgcaaaagtcagaggaatctatcctagcaatagactattattcggtttaacttgttggatgatgacttatggcacagtccctctaaacatgtctaaacggtcggagcagatgcaactccgagaaataagtcgaaatacccaaaaatttgaaaagcaatttctgtgtattcctccttatttctcggagtttaacacttctgtccccgctttttttgtacaaaaaagcagcggttcagctgatgcaaacatcaactgccgctgcatactattttttgcgaataatgccgtaaaacaatacagctgtagccactaatggaatgaagatcaccaatagaaagccatttggatatgttgcgcgagtgaagatttctgtggaagtatcatttgtgccgatcaagtggtttgctactaaaaattgtccgaccaatgcgatcattgctagaaaacctactgttgcccctgttccaaagaagatttttttctttgtgctgttcattgcgtctgcccctttaatattctctatgtcccattatacaaaaaaatgaaaaagtcttcaatgcgattttgtcaaatcattgattcgtaatacacttgaaatgaatttgacatatttttttagtcagctgactctttctaagtgaaacggcaatcaaatcattcgctgaactaagaggggtctcgtataatagaattaacgcaaatgaaagcgcagaaagaaggaataaaaatggactatcaatcttttgaaggtcaagaggcttttttcaatgattatcaacgagtagcaaaagcaggttaccaagaagaagaagtgatcgatgacgtgctggaacagctgaatcagcaattgactgcggaccagctaatttaccgagtggaagcggaaaaaacgaaagacggcgaagtctttctgtttcctttcagcaaattcatgtataccgaagatttggacgcagcaatctcgacagaatttcgctatgatggtgctccttatgtctatgaaacctatgaggatgaacaaccataattttcagcaaggtatttaaatcaagaactttttaagaggcatttgcatagacacaaaaataaacacccaaaggatgactcgcttgatgctgtcattctttgggtgtttgttgttaacggataggtgaggcaatgaaaaaatcaaagcaaacgctgagcgatctgcaaatcaccttcataaggttctttttgaccattgactttcaaatattgctcagcgcctttaccagctagaatcacgatatcttgactagcggcttcagcaaccgctgattggaccgcaaggctgcggtccatctgttcttcaataatgacagtaggtgcagtgatcgcagcggctatctcggcagcgatagcacgaggatcctcaaagttagggtcatcagaagttaaatagactttatctgcatactcagaaagcgctcgacccatgtcaggacgtcgtgattctgctttgccgccggcactgccggtcacaaaaatcagccgtccttttggccgcaatgtatgggctagctcactcagtgacttaaagcttaagtagttgtgggcataatcaacgatgattaatgcgccattttgtttttccagaacgatcattcgtcctggaatcgttacattaggcaagacagattgtgcttcttcttgggtagctcccgcaagacaagcagcaacgattgcagcagtagcattgtcgtgattgaattctcctagcaaagccaactgatagtcgccattcacaagaagaatatctttttcagaatggatgcggaatgatttaggatcgcccgattccgctggtaatacttgataatctccatcgcattggccataggtgatcaatggtacttgatgagcagcacaagtttcttttaatagttcaaaataatcgctttgtcggttaatgatcatttgtttactattgtggatcaactcgcgtttgcagaaaagataatcatcaaagtccggatgttctactggaccgatatgatcgggcgaaatatttagaaagattccaatttcataagtgatcccagagacacgtttggttttataagcttgggaagagacttccattactagatgtgtcataccattagcgactgcttcggccatcatagcatacaagtctaacgtttccggagtcgtcaaaactgcttcctgatagttctttccgtcaacagtattttcttcagaggagaaaaaagctactttctgattggttgttttggctaaaatctcccgcacaaaataagcacagctcgttttgccttttgttcctgtgattccaattttaaacagctgatcttgcggattgttgtaaaaagcctgggcaatacaagccatggctgctcggatatctgtaacgatgatgccataggcggaacaattttcataagggtgttccgaaacataacattgaagaccctgagcaacggcactttccaaatagctttctttgaacgcggcacctttacagaagaatagcgtatttgcgtctgtctgacgcgaatcataacttaatgaggtaaagatcaagtcgttcatttcttgtggaacggtataatgccattcttggccgataaactcttttaatagatttgcttcgatcaacaacccgcggatctgatggggggtaatggtaagtagtgacatcttggttctcctcgtttcaaaaagtttagtttattatagcatattcaggcaaatcgaatggaagacagcatgcgattggtcgttcttcttcaataatgtgaagaaactttaatatgttgcaaaaatagattgctcgaagtcctttttcgaattaaaatgaaggggatatgtttgtagaaagttggagagaactgccatggataatcatacgcaatctgcgtcaaaacaattaacgacacaagaaaaaatggctcaaggatcggcttggatgacactgggaaacattggttctcggttgctcggtgcgatctatattttgccgtggtactactggatgggagccaacggagataaagcaaatgcattgtttggaatgggttacaatgtctatgctttgtttttgatgatttctactgcaggaattccagcagcgattgcgaaacagatttcctactacaactcaagagaagagtatcgtacaagtcagcgcttgttcctgagagctttacagttgatggcaggatttggggtagtaactgctggtatcatgtacatagccgctccttggctggcaaccgcatctggtggcggagaagaattgattccaacgatgcgctccttaagcgtggcacttttggtctttccatgtatgagtgtgatgcgaggatatttccaaggaaatcaagacatgaaaccattcgcgatttctcagatcgttgaacagatcgcccgagtcttctatatgctgttggcaacgtttattatcatgcggatggtagaaggcgactatacagctgctgtgactcaatcaacgtttgctgcctttatcggcgttttagcaagtgttctggttttggtttattatttccagaagcagcgggttcggatggatgttttgctggacatgagcaaagaagaaacagagatccaaaccaaagaattggttttatccaccatcaaagaagcgattccttttattattgttggttctgggatcacaatttttaaactagtggatcagtatacctttgttcgaattatgaaaggatttacacaatattccaatgatcagctcttagacatgatggcaatctttggcagcaatccagacaagctgacaatggtcgtgatcggcttagcaacgtcgatggcatctacagggttgcctttaatcagtgaagcagtagcgaaaaagaatcaaggaaatttagctaaattgatcagtaataacctccagttgtattcctttgtcatgctgcctgctacgtttggaatgatcgtattggcgtatccattgtatacattgttttatcgaccggatacattaggggcaagcgtcctcgttgctgcttgtatctctggcttaatcctgggcttgttcatgctgacttctagcatgctgcaagggatgtaccataacacagaagcggttatcttcttctttattggtttgttgctaaaatttattttgcagtatccggccatctggctgttccaagtttatggtcctttagtctctacaacattggcacttggtgtgacttgctggctgaatattagaaaaatgttgactaaaggccacttcaatgccaagttgacctttagaagaacggttttgattttcctgatgactctcattatgttagtgatcgcgctgattgctcggcaattgtttggtctggtcttaagttcggatcgcaaagtccaagcctttattctttctctactggttgcagcagtcggtggcggggcctatatttatatggcattgaaaatccgcttagcagaaaaactactgggctcatcaatgattcgtttgcgtaagaaattgcgaatcaaataacccaataaacctgattagccgctgagatcgcatggatcgatcaggcggttttttcagtaaaaaagatcgcaaagagagaggcgagaaaacatgcgactagataaattcttagcagatatggggtatggctcacgaaaagaagtgaagcaagcaatcaagaaaggcgttgttgcggtcaatggtcaacaagtcaaaagtgataaattccaagtagctgaacaagaggatcaggtttcgtttgcaggagaactggtacgttaccagaaagatttctattatttattgaacaaaccggctggtgtgatttctgcaacgaccgatccggaaaagacagtcttggatttgtttgcggcggaagattatcgccgggatctttttccagtcggtcgtttggataaagacaccgaaggactactgctaattacgaatgatggccagctagctcatcggttattgtcacccaaaaaacacgtcgaaaaagagtattatgcagaagttcgagggatcatgaccgaagaggatcgtcaccaatttctccaaggaatcgaactggatggggaaactctcatgccggcacagctgacgattttaaaggtagacgagcaggccgagacatccacgattaccttgattttgcatgaagggaagtttcaccaagtaaaacgaatggtgcaggcagtgggaaaagaagtgacttatctcaagcgtactcgaatgggcgggttacagctgccgaaagatttggcattaggagagtatcgctcagtgacagaaaaagagctggcacagctttctgctgaaccagcggaagattgaattgttgcagcgaatgaagcctgacggctgtgcccagtatgtggaatgagactagaggcaatgtctctgctgcttcagaaacattctgtccatcaccagagcccaggcagcgctttgatctgcagtgactcttgtgagaatggatgggtcaaataaagttcataggcatgcagctcaaggcgagctgcagtttttttctgataaagagggtctccgacgataggatgtccaatgctagcaaggtggacacgaatctgatgcgtacgtcctgtatctaatacacaatagatcgaagtcgtttgggcattgcgagcggcaatctcaacgtgtgtcaccgcagataagccattgcgtgggtcaatgactcgtttgcgacggtcgtggcgatcgcgtccgatttttttgcgaatggtttggttttgatccaattgtccccagactgttgcttggtagcgacgataaatttgcttactttcaagcattcgtcccaaaataggcaagactaaggggtttttagcaaataaaatgacgccgctggtctctttatctaatcggtgaacgacatagggtcttgtctctggtgaaagatatgcagccagatcattcataagtgtgtcggtttcatttggttggttggggtgggttttgataccagcgggcttattgacaacgatcagatgttcatcttcaaacaacaccgtaatcttctctttgttcccagaaatcactggctgatacgtgtaatctgcttcttctagaagaagcgtgagctgatccccacctgctacttcctgatgaaaaagggctgtttcaccgttgacgcgtacatttttgcgggttcgcagtaaatggcgtactttgcgagggacgagccattcttgttctaataattcccgaatcgttgttcggggatggtcattaggtaatgtaatggtatattccataaaaatccctttctaagttgtgatctatttgctattatagcatctttaagattttcttataaaaaaaacaacaaaaaacagaagtttcgctgatagaattgacgagcaatcttttgtggatgaaatttactgctagagccgtattccaaacggtttgatatatgctacactttgttaaaaggagcgtggagaaatggatttgaaacaaatccttcacaagataaaagaatcgatccaaactttctggcgttggatcaagccttatctacagcaattccatcaatggcgcaaacgcatttggaagaaatatcatgtgaataaaatagttattttactgactttagtgggtattttagtgatgagcggttacttgttttatatcgccaagaataccaaagttagtgaattagaatcaggattgaaagagtccactgtgatctacgatgctaaaggagaagaagctgggcagctctattctcaaaagggcacctatgttgatttaaaaagcatttccccagcagtcgttcacgcactgatctcaacggaagaccggaatttttataatcaccatgggtttgatatcaaagggatcgctcgggcggccttgcggatggtagtcaatcgtagtgcagaaggtggcggtgggagtacaattacgcaacagctagcaaagaatgcctatctttctctcgatcaaacctttagtcgaaaagccaaagaactgtttctagcgattgaaatcgaaaaaaaatactcaaaagatgaaatattggaaatgtatttgaacagttcctatttcggtaatggagtctgggggattcaagatgcttcgctcaaatattttggtgtcaatgcttcagatttgacggtgggagaagcagctaccttagtaggtatgcttaaaggtccatcaatttataatcctatcgatcatccagaaaatgcgacgaaccgccgagatactgttctaggactgatggtggacaacaaaatgctggatcaatctgtggccgatcaagaagagcaagtttcaatagctagcctgttgtacgatggctatggcaattcagaatctggctataaatatccttattacttcgatgcagtgatcgatgaagcggagtcttacggacttgatgcggatgatgtgatgaatcgtggatacaaaatctacacagcactggatcaaaactatcaggcacaaatggaagctgcctataaaaacgatgcgctctttccagaaaatgcgtctgatggaacgatggtccaatcaggttcggtggcattagatccgacaactggcggtgttcaagcattggtagggcgacgaggcgaacatgtttttcgcgggttcaattttgctacccaaatgaaacgctcgccaggttcgacaatcaaacccatcagtgtttatgcacctgcaatcgaagcgggctataatccagatagtattttggaagacaaacctcaaagttattatgaggcaaagaattacgatgggacctattccggtgaagtgccgatgtatcaagcattggctcaaagtttaaatctgccagctgtttggacacttcatgaaattggtctcgaccgcggatacaaaaagactcaggaatttgggctaacattgtcagaatcggacaaatattggggattggcgttaggcggattggaaactggcgaatcaccgttgaccatggctgccgcgtatggtgtctttgctagcggaggctattactaccaaccgcatttgatcaccaaaatcgttgattcaacgggcgcggttattgtagataatacttcagtcaaaggaaaacaagtcatctccaaagaaacagcagacaagatgacaagcatgatgctgggtaccttctctaatggaactggggtcagcgctagcccttatggctttacgatcgcaggaaaaaccgggacaacggaaacaaactttgatttatcaaaagtcaatgatcagtggatcgttgggtatacacctgatctcgtaatctccacctggctgggctttgaacaaacgagtgccgaacactatttgactggaaccagcgggcaagtcgtcggcaagatatttaaagcggaagccgaaagtctgttgccttacagccaaggaagtcagttccaagtagcagatgcctatatgactggtgggaaactgatggcagcagatgaagtgccagatccaaatgaatcaacggacaacgatgactggaaaaaatcagttgacgagtttgccgaaaatgccaaagaaggattaaaagattttggtgagcgtgtcaaacaaggaaccaaagagctttttggtaatctatggaatacgatcaatggtaattgatgttagcttctactgcatgtgcatccgaacagtatgttataataagaaaaaaacaaagtgagggaacagtatggcaaatatttatgacacagcgaatcaattagaacgagaattacgagaatccgaacagtttcaagatttaaaagcctcgtttgatcgtttgaaagaaaaccaagaagcgtatagcttattcaaggagttccaaggcttgcaacaagctttgcaacaaaaaatgatggcaggccaagaaatgacagaagaagaagcacagcaagcacaagaactctctcaaaaaattcagcaagatccaatcgtttcggaattgatgcaaaaagagcaagcatttagtctggtggccaatgatttgaatcgaatcatcatgggccctgtgcgggacttatacgaagcctaagcgctagcctgctgacttaccgcagcacaaaagagtccaagaggggttctcaaacagaggcctcggacttgtgccaattctatgccaatttacagtgctttagatagcgttagaggctaatttgagcggacaacattcgaaggatcggggacttcctcgacccttcgaattttttgttcaaaaaggcgaacaaattttcgtgttttgctgacgaaaaaacaaagaaatgttatgatagaagcaaaagggggaaaggtatcatgcgttttttacatagtgctgacttgcatattgatcgttctttcgaagggatccgcatgttatcggataacgtcaaagagcagcttccgctgatcaatcgaaaaataatcaaaaaactggttgatacggcactggagcatgaagtggattttgttctcttggcgggggataccttccaccaagcccgtccaagtctgcggatccagcatgacttttttcaagagatttcccgacttgcgtcagcagagatccctgtctatatgatctttggtaaccatgattactatgatccgcagcgttattggtttgattttcctgagaatgttgtgctgtttcccagtgagacggttgaaacgatcaaaggcgtaaccagaaatggtgagacctatgctatcagtggctttagttatcagcagccttggattacacagaacaagatcagggaatttcctaatcgccaagcggttgatttccatatcggtatgtaccacggggatagtgcgggggaacattatgcaccattttctgtgagtgaaatgaagcagaaaggctatgattattgggcactaggtcatattcatgttcctaagatcctttcagaagaacctgcgatcgtttatccagggaccccacaaggcaaaacgcaaaaagaacaagatacaggcgttgttttagccactttgagttcccatggtaccgagatccagacggtcgacgtagcagaaatcacatgggcacaacaagaagtctcattagcagcttgtaaggatcagcgttcgattttgcaaacgattttgaaggaggtcaacacgaatcagccacgactgatcaaattagtgctgacagatacggatcagttatcttcagattggttttctgaaaccgaaaaaaatgaaatgatcgcctatttgaacgagcagctgtcaagagacgtattacagacaatttatgcaatcgaagtctacaaaacagagacagacaaaattccattagcgatcccggcgtcctatgttgatcaattactagctatttatcaagacccgtctatttttgctgaaggactgaatgatttgcttcgtcatccgttgctttatcgcgggattgatcaaggtgcctttcaagaagaggtcttacagcagacgaaacacttgctggagaatgatttccagtgggaggaagaagtatgagaatcttaaaagcagaaatcactgggtttggccgttaccatgatcaagtgattgaattttcccaaggaaatcaattgctttttggcaacaatgaaatcggcaagtcgacattgtatcagtttattgcggctatgctgtttggttttcctaaaagaacagctaagaaaaaggattatacccccaaaaatggggccgcttatggaggcagattgtggctagttgtcgaaccttacggggaagtgatgatcgaacgttaccgtcaaatcgatcgaggaagagccaaagtccatttcaacgggcagaccggcgacgaggaaatgctggcacagttgctgcaacccttgaatcagacgttgtttttcgatgtatttacttttcagcaagaacaacttgcccaaattgacaagctgcaagaaaatgaattgcatcaagcactgatttctttgggaatcagtgggagtcaaaagatgctgcaacaagtggctcgctatgaagcaatcaatcaacaaaattataaaccgcggggacaaaaactccctttgaaccaagcgttgaaacgtttggagaaactacaggagaaaattgcccaaaaagaaagcgaagaacatcgcttgcaacagcagtatcagcagatttcacagattcaaaaagaattgcggcaattagaagaacagcagcaagtgcaaagcgatgcttatcaagctgttcaacaacagatcagccattggccattgtatgaagaatggcaacagctatcaagccagccagctgcagtagcagaaaaagacgctcaggaaatcagcagattttatcagacctatcagcacttaacagaagatattcatcaaaaagaagcagaacttgatcgtttggaacaagggcaagcttcagataaatatttcttttatctggacaacgaacatttgatcactcagatccttcagaaacaagttgagatggcccgattgatggatcggcaggaacaggcgctagaaaaggaacaacaagcacgaatggcgttgaaccagctgatcaatagacggcaatggtcaaaagaatcaccaccactgcagacagaacaaatccaggaacaattaatgaatctggagcaaagcgactaccagttagaggaagcaaacaagcgcttagagtggttagaagagaaggaaaatcatcttcaacatgctttatcacggttggaacaggcgcacccaggattgatgggagagcaaaaaatggctattcctatggtgccattagtaggtggtttggttgcttgtgttgcagcattctttttaccgtctccttggcgctggttgtgtatagcggctggcaccgttggtattggactagcaatttgggaggcaatgaaacaacgtcctcataaacaaggtgacagcaaaaaacaatggcaagagttattgttgcaaacggatctggttgcctcagagatcgcagatctgacagaagccaataatttacaaaaacaacagaatgaacgatggcgtcaggcgctgcaacctttttttggcacggaaccttatcacagatggtcggtcttcttgctgcagtaccaagaggatgttactaattatcagttgcatgctcatcagcttcgcgaagccaaagaacaactgcaagaggtcacagaacagcttcagccttatcaagcgatgtttacaccttttgctgattggttgcccctgcaaaataagacaatactggagcaggctcagctattgcatgaattcaatgaagagatgcaggctgttaaattggcgcgtttacagcagcccagcacgttgttggcgcagcaacttgctcgcaaaaaggcggagcgggctgaattgttgaaggcttctcaagagattctctcacaagttggcattgatcagccagcagaaatcagtctttggctcaaacaatgggagacgcatcagcgggcggcaaagcgggaagccgaattagcagtcatgctggatccgattttcccggaaccaatcacacaagaagaattgctggaaaagaaaacgcaagtggcacaaaagcaaaaagagctgcaccagcttagtcgacaaaaggcagagcaaaggcaacggcttgaactagaagtagccgccagccaaaaaagcggtacgttgagccagctctatcaggaagaaagcgaactgcgggcaaaaatcgaggaattggctcttgcttggagcagtcgacaattagctgcttcggtattgtccgatttgacgactgaattgtctgagcaacaattgccgcaattactagaaaaagcttcgatatatttcagattgctttccaatgactgctatcaccaagtaacactgcatgaggggcaattagttgccagcaatgctagcgatagttactcgatcatcgatctatcaacaggaacaaaagatcagctgatcatggcgatccgcttcggttatcttgcgttgcaacaaaatcatcctcttagtcccatcattatcgatgatggctggttgcattatgatagtgcacgaaaagaacggttagcggaattattcgctgagtttggccaatattaccaagtaatttgtttgtcttctgaccaagaaatggtaagctattatcataaataccagcaatccgtacaagaacttagtcaaaggatgtgagaaatttggctatgcgccaaatgttaacatgaaaaaaattcgagaattgaccgtagatgagacgtttcaactgtttttgttgattaaaaatgcggatgttcgtatcgcaaaaaatggcaaaaagtttatcgcgtttacttttcaagatacttctggaacaatcgacggaaagttttgggatgcttctgaggaagaaatcaatcgcttcgaggctggtaaggtcgttttattagatggaaagcgagaagtttatcaaggaaatccccaagtcaagattttgcatctgcgtctggcaaaaccagaagaacctcatgacccgagccagtacatggaaagagcccctctgaaaaaagaagacatggaagaggaaattaatcagacattgtttgaaatcaccaatcctcattggaatcgtatcgttcgttttttgctgaataaatacaagaaagaattttttgattttccagcagctaaacggaatcaccatgcctttgctagtggattggcttaccatacaacgaccatgttgcgaatcggaaaatctttgatcaaagagtatccggaaatcaatgcaccgcttttgtatgcaggaattatcctgcatgatttaggaaaagtgattgaattgacgggaccaatgaccacagagtatacattagctggaaatctggttggacatttagtgctagtagatgaagaaatcacccaagcgtgtattgctctgaaatttgatgataaacaagaagatatcgttgtgctgcggcacatggttttggctcatcatggattgttggaatatggctcaccagttcgcccaagaattatggaggcggagatcctgcatcaaatcgataacatcgatgcttctatgcaaatgatgttgtcatctattcgcttaacggaaccaggagaatacactgagcggatttttgggatggataatcgtagtttttatgtgccgaaagatgtataaataaaaaaagattggcttttgccaatcttttttttctgttatttttcagaggaatctgtagcagatgaactagttgtttcagttgattcttttgtagaattagttgcattctctttgttatctgatgcatctgtagcagaagaatcagttgaatcttttgtttctgctgcagaaacatagtcagaaagaatatcagctagatcttcatctttcattttcacattggcagctttcagttctttaccaatcgtttttgccacgaatgtagaatcgttcaatagcgtgttttgtgcgatttctgtgatttgatctttgtatttatccatgtcgttgcctttgtcttggtttttgaccattttgacaatgtaatagcttgttgtataagtagaagcatccgtagcagaaatgacctctgaaatttcaccatcttttaatgcaaaggcagctgtttgtacttcagctggcacagttgttgaggttgagtcgaatttgactgtaccgccatcttctgcagtcgctgtgtctgttgatttttcttttgctaatttactaaagtcagcaccatctttttgagcttcttttaatacatcttttgcatcatcttcactagtcaatttgatcaattgtgcttcaacttctggatggaaagaatcccaagctgctttcagctcatcatcaccaatatccatgttcgcttttagcccttcttgtaatgctaattgctgtctgatttgttcacgatagctttttttagtaagtccagaagcttccaatgcagactcaaatttatcactgtcgccatattgtttcgcagtttgatcgtattgcttgtcgatcattttctctgtaacatcatccccatatttttgatcgaagacttttaagacgatcaattggcggataagactttggttattctgatctgtttttgcttgttcgtaaaaatcttcaaccgtgattttaccgcctttcatggttgcaatctcattacttgaacttccggaacaagcagctaatgtcaaaacgctcagtgcactgactgctgctaaaatcaattttttcttcattcgtttaagcactcctattttctaaatatttcaaagaatcacagctaatactataccacactctttttttaattgggaagaaaacaaatgatgtttcaaacaaaattcatagattctccaatatttgctacttattttcttcttggggaactgatttggcttgtatcgtcgtgacatgttggttcaaacgatccacgtgggtctttatccgctcgattcttggctgtgcttggaatttgaatgattcaaaatcttttgtgaaagactctttgacaacaggaatcgtttcgtcaaccgttttacgcgtcaatgtgacagcatcttttaagtttttgacactttcattaaactcaagagtcgcttccgtggtctcatcgacataacgaagcatttgttcacgggtttctttaccgctttttggtgcaaatagcagcccgcctaagccgccggcgagagagccgaataacaaacctttgataaagttaccgatcatttagtccaccagctttccgattttttcagcgatctctgttagctgttcctgtgagtaatcctctgcatgattaccgaaatgcatcgagaaatcatctttttcatcgtaacgaggaatcaaatgaatatgggaatgaaaaacagattgataagccaattctttattgttattgattatgttgagtccattgatctcaggaaaggctttttcgattgcccgagcgattttaggaacgcgagcaaagacctctgcagcaagggcttcatcatactcaaaaatatccgttacgtggactttcggaataactaatgtatgtccaggtgttacttgggaaatatccaaaaaggcatagacttgatcatcctcatatactttgtaactagggatgtcacgattgttgatcttacaaaaaatgcaattttccatttcataaacctccttgttcttctagtcctactttaccatattctgctgatttcggcagtttttgttcttgaattccttcaaaagcaggccatcgcttcttttccatgtaaagtacggatgtttgtggagagaaacgcttgcatttgtccgcttgcaccaatagacttaaaagcagaaatagaaaaggacggatacgatgaaaccaatcattaaagaaacgttacagaaaaaaaagaccaaacgagaaaaaatcagctatcttgcctatgcatataaggagtggctgattgcaggactagcagtcattctagtaggaggttcgctgatctattcgatgacaagaccaaaagaagttgtttatacagtggctgttgtttctgagaccagtgaacagcagcccacacaatctgaatttgaaaaagcagcgacggattgggtgaagcaaaacgtggcgcctgatcacgaaataacagttacatttgtttcctatgaagatccagccgctgtccaagcctttacgacccgtttagctgccggagcaattcaagccgtcatttttgatgcgtccgaagcagacatgtgggtcgagcgttttggtagcagtgagctgccaaaagaaccattgcaagtagctggacacgagtatgttgttcaaataactaataacggaaaatagcagatttcaagaagtagatgactgctctttgaccgctgcttcatggtataatagttgatattggaggaacgaaaatgacattacaagtagaaaatgtaacaggcggttatacacagctacctgttctaaaaaatattgatttttcgatcgcggatggtgaacttgtggggttgatcggtttgaatggtgctggtaaaagtaccacgattaaagaaatcattggtctgctacaacctcacactggaaaaatcactatcaacggactatcgctgaaagaagatccgcaagcgtatcgcaagcagatcggctacattcctgaaacgccttctctttatgaagaattgactttaaaagagcatatcgaagtaacggcaatggcctatgacatccccaaagatgtcgcactgcaacgggcggagcggttattaaaaacatttcgcttagaaaataagttggactggtttccagcaaatttttctaagggaatgaaacaaaaagtcatggttttgtgtgcttttctaattgaaccaagtttgtacatcatcgatgagccttttttgggcttagatccattggcaatcaatgcattgcttgaattgatgaatgagatgaaacaaaccggggcatcgattttaatgtcgacccatatcttggctacagctgagaaatattgtgacaagtttatcctgcttcacaatggcgagattcgagcccaaggaacgctgtcgcaattacaaagccaatttggggctgaaggagcttccctcgatgagttgtacttagcattgacaaaggagagtcagctatgaaggggttcttctcacaacgcttgcaacgacaccagaaacagatgagtcgctatttgcgttatgttttcaatgatcattttgcgatcctcatcacatttctaatgggtggactgggtctatattattcgaattttttaaaaacgctccctcggccgttccctcagggggggatcgtattgctattgatctggttggcacttttgtcagtcggcaagttggcaacattggtgaaaccagcagatttgatttttcttttagctaaagaaaagcagatggcggactatcttgctcaagcactgcgctattcaatgtggctgccttttggggtctcctttttagtcgttggtgcgacgatgcctttagtcgtagtagttactgaacaaacgtttgcgagctttttcttttatttagggacgatttggttattaaaagttacggatctctggttacagcgtttgtctctttatcaaggacaagaacagcgtaacaaccagcgtgttctgtgggtgattgctgcagtaagcagccttttagctagtctgtatgttgcaccttgggttggattgctcttagctgttctacaagctgcttggttcaaccttcagtgtcgtccgacaggtcttctattaggttgggatcgcatgatccacatggaagaaacgagacttcatcgcatttatcggtttatcaacttattcacagatgtacctcaaatcacagcagcagccaaacgccgcaagtatttagatggtctgttgaataggattccttttggacaggaacagacttatcgctatctatatgctcgccgctttttgcgaggggaacaatatagcgggctttttttccgtttgacactgattggtgtattagtgcttttctttgttcaagaatggtggcttagtctagggttaggatgtatgtttctttatttgatcggttttcagctactgccgatgtataatgagtttcagtacatgattttgactcatttatatccaatcgaggaagggcaaaaacagacagccattaattggctattgcttagattattaggcggagctgctttcatttttggtgtagtcggcttgttccgagcggcaattctttggcaaggagtgctagtgctgttgggctttttgttatttacaggactctttttggttttctatgtacctgcccgcttgaaaaaaatgcaaagtcaataaagatggctggacgttactcgaaaaaaccgaacgcatatgcgcttgacgttgactctttaggaagctagaataagagatactgtgaaataaggagagaagctaggatggatattcgcttggatcaagattggcgcctgagaccaatcaaaggcgacaccggcaaagcctacattggcttgaaggacaatgataaagtctttatcaaacgaaatacgaccccgatgcttgcggcactctccaaagaggggattactcctaaacttgtgtggaccaagcgtaccggcaatggcgatacgttgtctgctcaagagtggctagatggacgtgtattggaccccgaagagatcggtcaaagaaatgatgtgatcgatgtattgtatcatttgcaccattccaaaacattagcgaagatgctgagcaaaatcggtggtcaagtgatgacaccagaaaaaatgttagttgaatatgaagaaaacttacctaaagcggttgttcaaaatcgctttattgctattgtttatcgttatttaagagagaatattccagaatttcaggaacaaaaggcctccgtcgttcatggggatgtcaattaccgtaattggcttgtttgccaaaactatctgtatttggttgattgggattcgatcatgtttgcggatcccgcaatggatatcggtacgatcttagggcattatgttccattatccagctggccgcattggctagtgcgttacgggattcatggcagcagtgaagtgatcgagaaaatttattggtatgctttattaagtatgcttcaggaagtaaagaagtactaccaacgcggggattataaagcaatgaatgcagagattctgcaattaaaaagaatttatagtgaatgagaagatggagcgaagcaacaagttccatcttgttttttcggaaaggaaacaacatgagagtaagaaaacgtgcgggagcagaagaattagtccaagcgcatcccgaatttgtagtagctgaaccgacagcgtggaaaggccgttggaaggaacgatttggcaatgatcacccattgcatattgaaatcggtatgggaaaaggccgtttcattaccgaaatggctaaagcacatccggaaattaattatattggcatcgaaatgcaaatcagtgtggtttccattgcactggataaactgatcgaacaagatatccctaatgtgcagctgctgcacgttgacggttccgcattgacgaattattttgcggatcatgaagtcgatcaaatctatttgaatttttcagatccttggccaaaaaagaagcatgagaaacgccgactaacatcgaaagcttttttggcagtcgatgaacaaattttacgtccgaatggtgaaattcatttcaaaacggacaatcaaggcttatttgaatattcactcgccagcttttcacaatatggtatggttttaaaacaagtatggttggatcttcatcaaagtgactatgaaggaaatatcatgaccgagtatgaagagaagttttccagccgcggtcaaagaatctaccgggtagaagcccaatttgtggcaccagaagatacgaccaaaagttaaataagcgagtcctagcgttcagactgtagcacaaggcagaaaatgtctttgttctacagtttttttgtatagaaaagtaaaagctgcgtatctctttttaggagggtgacaatggacatttgtacattttcagatgagttggtggagtatgcgaaggtgcagaaaatgcaagatctatccatactgccaacagtcgaagggatgactctgattttcagcaaaagttactatcggcaaatgtatcgcaaagttactacagaagacgcgcaacaattgatcactcgattcaaatttctgggcggtatggaagtaggagaaaaacgaagagcgcaattaggggctatcagctatcctttggcagatggagagcagcgtatccgggtttcgactgttggggattttcaaggtcaagaaagtttagttctacgttttttgcaccctttaggtaagttccatcgattctttatgaatgaacaatatgaaacgatcgcagatgcatgccgctatcgagggctctatctcttttctggtcctactggatcggggaaatccacactgatgtatcgcttagcttcagctgcagcaggtcaggtgatcacgatcgaagacccggttgagatcgttgagcctcgttttttacagttgcagaccaatccaatgatcggccaggattatgatgagctgattcgtttgtcgttgcggcatcgacctgagctattgctgattggtgagatccgcaacaaagagacggccaaggctgcgatccgtgcggcactgacaggacatcgggtttttgcgacgatccatgcacggggattaacggaaacaattgcgcgattgcaagagctgacagaggaagcagctgtgatcgaccaatgcctccaaggaatcatttatcagcgcttactgccagatcttcacggagtccctcacgcattgatggcctacaccttttatgaaccccacaaatcctcaatgacttgggatcaagcactaacaaggatcagagaaaaggagcagatcacccatgaggtttttgacaaggaaaagtaaacggctttcccgcaaacagacccacgccttattagccacatttacggttttattagagagtggtttctcattacaagagagtttgcttgttctacttcgcagtggccaatttgatccgaatacagtaaaagatattgatcagcgactgaaacaaggtcaacgactcagacaggccttttctttgctgcatttatctgaagccgaacaaaatcagctggacttggcagagacccatggcaatctggtggatacgttgcagcgaatggtcgcttaccagatccttttggaaaaacaaaatcagacattacaaaaagtgttggcgtatccccttctattgctggtatttgtctttaccgctctctttgccatgcgtcggtttctattgcctcaacttctggcctccggtatgatcgatgcgaatcattggggcattctctttattacggcagcaccatggatcggtgcggtcattgtaggcggattgggaggtttcgttcttgttgtaagaggaatctttgccaagcagacagcgttgaagcgagccacttttttgagtcgattgccttttttgggagacttgtatcgctgctatcaaactagttattttgcattagagtggggaaaattgtttcagcaaggcttggaaattcgtcagatcattatgtgcatgcaacaaacaagtacagcaacattagtacaagaactagctgttcaattagagctgtgcttggcaagtggcggattgttgccggacaaattaaaggactatgtatttttgacgccagagttttcattgattgtgttccagggcgaaatgcgtgggaaattaggagaagaattgtttgtttatagtcagcttttgacagatcggcttttccaacaaatcgagaagaaaatccagtggattcaaccagtcatttttttattagtggcccttctgatcgtgggtgtttatgctgcaatgtttttgccgatttacggcaatattcaaggagtgatcgaatgagaaaattgaagcatcaagggttcacattggtggagatgctgattgtactgttagtgatcagtattttgattttattgtttgtaccaaacttatccgcacaacgtacagtgatagatgagaaaggaaatgcggcaatcgtcaaagtcgtagaaacccagattgagttgttccagcttaatgagaatcgaacacctactcgacaagaattactagctggaaattatgtaacggaggagcagtatgcgatttaccttgcccatcggaacgaatagcagtttttttacttggcggggatttacaatggtggagagtttgattgtcctcttagtcgtttcgattttcatctttcttccgctaatagctatcgaccgttaccaagcatattttgaagtgtgggggttttgtgctcgtttggaaaaaggattggcagtagcacaacaaacagcgattattgatgctcgcgaaacgaaagtcgcttattctgattcaccagttcctacgatatattttcattcgacgatcacaggtgaaatcaaaatggagccacttgaagtaccctcgcagctcgcagtacgtgtttttcctgtacttacattcaccagtcaatctggcaattatacgcggatggaaacattacggtttgaatggatggaccaagaaaaaaagattacctacaaatttctttttggaagtggacgatatgataagatcatcgaataaaggatatatcatgctagaaagtatcattggctttggtttgctgacgacgagtgtcttcctttttctgactgtccagacccatattttacagcaaagtgcacagttacaggcccaggtggctgctattcgggtattgtatgaagaagtccaatgccaagcatttgaacaggaagtcgtttattcgacacaacgtacagagtcgtatcagttgtctttcggtttcaagcgtgaccgaagctatggacggattgtaagaggtcctcttatcatggagatcaactatgaagagtaagggttttactttgttggaatgtttgctgtctttaatgatcttaggactcagtgtgttgttgatcaacggaatcattcgccagatgcctcaagttaatcaacagctttttgctcgcaaagaccaagaatggcagatatttttgattcagttagaaagggagcttcaaacgtgtacgtatgtttcagtgagtccgtatacactttttttaaaaagcagcaaagaaaatgtagtcacgatcgatcgaatcaatgggaaagtccgtaaaagagacaataatggctaccatccgttattgacggaagtatcattgatttactttgaaaaaaaggcatcctcgatccagtttacagtgactttcgagaatggagaggtgagaattggtcaatggcagattcctgcataagggcggtatctttttgtcagcaatgatgctgattcatttgctgagccttatgttgctaacggttttagaaaatactcggacaactactgatttctatattaagactcttcacatgtatgaggcacgaatcatgaaagaactttttttggcggattatcagcggttaacctatgccgagcagggcagtgtcaactacaatgtagggagggtcatttacgaacaaaaagaagagctgttgttgattcaatgtgtcgtcaatcagcgcaccttccgttttaccgaaattttgtcaggtgatttggaaaaaatagcaacagatcttgagtaactataatacagaaaaaggcacagacatactgtgtcttttttctgtataaaagagttgaaaagtatgtttgtctcttcacaaattattctgaaagatagcgattgattattttggctgaatcagctaaaattaaacaggtatgtatgttgttatagttttgaaaagaggtgcaagatgtccccagaaaaaatggaagagtcttttcatttatcgctagaagcgattcaagtgctccaaaacgcattagaaacatcttatttggatgcatatatcgagacgatcgagaattttattgatcagtatcgcgtacgggtgatcgacggagtacctagtgaagcggatgctcaacggttggaagcgatttataaaaaattagagcagatacccttaacagcagaagaacggcgtaaacttgctcaactacttctgttaaagggcggacaaaccgaacatctgcagcctaatcatcagctgacaccagatagtatcggttttttgtttgtgtatttgatcgagcaattgacaccagcgaagcaacaaaccaagattctggacctttcggttggaatggggaatcttgtcttaacgctcttgctcaatttgcagttagcgcaaagagatgtgcaagcaacaggtgttgacattgatgaaacattactgagtgttgctgcagctacaagcgaatggactcaagccccgctgcatttgtttcatcaagacgggttgcaagaattgttaatcgacccaatggacattgctgtcagtgatttgccagtcggctattatccacaagatgaaaaagcagcatcgtttcttacttcagctcccgaaggcgaaggacatagctttgcccaccatttattgatggaacaagcaatgaactatgtgaaagaagatggctatggactattcttagctccggctaatttcatggaaactgaacaaagcgattatttgaagaaatggctcaatgaaaaagtttatctgcaaggaatcattcaattgccagacgagcttttcaaaaatgagcgatcaagaaaaagtattgtgctgattcaaaatcatggtgcaacgagcaagcaagcaccagtgttacttgctaaactcgcatctctcaaggaaccaaaaaacatcaagaaatttttcgaacaatttgaagcttggaaagcatcaaatttgtaatataaatcggataaggagaaaattatgtctaaaacaattgcaatcaatgctggaagttcaagtctaaaatggcagttatatcaaatgccagaagaaacggtggtcgctaaagggatcgttgaacgtatcggattaaaagattcgatttttaccatcaaatatggggaagatcaaaaattcgaacaaatcatcgacatcaatgatcatgaagtcgcagtaaaaatgcttttggatcaattgatcgaattgaacatcttaggttcatatgatgaaatcactggtgttggtcaccgtgtcgttcatggaggagaagacttcccggattctgttgtgatcacagatgaagtgatggaacgcattgaagcattggcagagtttgcaccattgcataatccagccaacttgatggggatcactgctttcaagaagatcttaccagatatcattagtgttgctgttttcgatacttctttccacgcaaccatgccaaaacacaactacttgtacagtctgccattggcttactacaacgactataaagttcgtaaatatggtttccatggtacaagccaccgttatgtgtcagaacgtgcggctgaaatgttaggcaaaccgattgaagatttgaaaatcattacttgtcatttaggaaatggcgcatcgatcactgcagttgatggtggaaaatctgttgatacatcaatgggcttcacaccacttgcaggagtgacgatgggtactcgttctggtgatatcgacccagctgtattgccttatttaatggaaaaattagacctatcgatcgatgaaatgatcgatgttttgaacaaaaaatctggtttgttaggactttccggtatttctagcgatatgcgggatcttgaagctaattatgacaaagaagaagtaaaagttgcgtatgatgtctttactgaccgcattcgtaaatatatcggtggctatgtaacaacaatgaacggtgttgatgcaatcgtctttactgctggtatcggtgagaacgatgcccatgtccgcagtgaggttatcaaaggaatgacttggtttggttgtgaacttgatgaagaacaaaatgccaaacgcggcgaagagttagtcatttctacagaagattctaaagtgaaagtcttgttgattccaacagacgaagaattaatgattgctcgcgacgtggaacgtttgcgcggttaattgtcggagatcaattggaacaaatgagtttcattatttgaataaaaaaagtgttaagccttggcttaacacttttttgttttgaacagctgtacaccttggataccaatgaataatgcttgaaagtcgcaaatttggttagcgctattcttatttttctttatattttcagaaaatccaacggtggaactcaaaacttatctagccattttctcatagcttttttgactttggttccatttcgttgtcagaggttgcttggtttaccagcaatccgtccgcaaaggcggccacgtcttcgccagttacttgaagaacacttttttcttgttgcgcattgtcttcaaacaaatccaacagatcaacgagtggttggaaatcgctggcaagatttactggatcaactttcataaagtacttttggatttctttatagacgattcgataatcattcggcaactgatttgcccgtttttgcagagcacgccattcttttttaccttctaatgcttcttttattcccatcttcatccctcactttagttttttggtcacttgattcaagtgttctcgcaatttgtctcgctcatttttggcaccagctgcttcagcgatttctgagatgaaggtagtcatattttcaccgatcacgctattgatcggcagtttttctgcggcactttcttcaaaaagaccgacgatcccttccaagatagggtacagatttcttccagaaaaatcactgtagctccagatcttttgattgtgttcgcgccacgcatcttggtagccagcgggtaacttatcaatacgaagttgaaattctttttgttgcttattcatgtcgttacctgttattttgtcataaaagttcatggtgggcctcctaattaataaatagttgtttgtagcgtttcattgacagaaaagagaaaaaacttagtaatatggctagccacaaaagggtcaagaggctgctttgggaaccaaaagagaatgtaccagcaagcaaattctttgtcgtttcgataatgggcgtcattggctggttctcagcaaataggcgcacaggttttgccattccagcgactggcacaaaggctggactgataaaaagcaggaagatcaaaatatacgaaaaggctcctgctccagcataatcttttgctgttaacgagaaggggatagctagcacagtgagactaacggcaaaaagtacgatcaaaagggtgaaaagcaggaagtcaccaatcgttgcttgtggtcgataacccaatactagtccgatcagcagtacagaaagtacagaaataagcataaaaattgttgaggcgacaatgtgcgatcctagaatcacccaacgtttcattggcatagataataatcgcgtcaggaatccttttgttttatcattgttgatcctcaaagcagtgtaagccgatcccattgccatagacatcagcaaaaatcctggcataacgtagctaagataatctgaaggctctcctgcagtgcccccgactaaaatattgccaccaatgacataaacgaaaaaaagtaagatgaaaataggcataacgatacttgtaatgatcgtatcgacacttgttaaattttgtctaacgatgcggttcgttaatgtgaaaagttgcttgattgtcttcattttttagtcctcctttccagtagcatccaagaatatttcttccaaactaagttcaatcggagcagttgttagaatgtcaatatcattttgcaagagtttcatcatcgactcttttaaatcatttctagcaagaataatggtgtcattttcaatcatatagtgaatcgcagattcgtttagaagagaagtcgcttgatcgatcactttttttggaacgatgactttgtgcagatctcttgcttgctttttcaattcttgtggtgtgccaatcaatgaaatcttcccatcgttgataaaagcgattcgatcagctaaacggtctgcttcatcaaggtattgagttgtcagaaagatcgtctttccttctgctttaagctgaaggattagttgccaaatctctaatctgttttttggatccacaccagtagttggctcatcaagaaacaaaatttctttgtcagggagcagagagactgcaatatctagtcgtcgcttcattcctccagaataggtagcgacttttttatagagaaaatctgctaaatgaagtcgttctgataaggtatctattttcctgcgcagatgagggatgtccaacagcgtgccaattagtttcaaattttcaaaaccggtaaattcatcatctagtgtgatcgattgactattcaagctgatgacatcccgcacttgatcggagtcatttcataggtctaaccctaaaattgttgcattgccggatgtagggctagcgagtgtagttagaatattgatcagtgttgactttccagcaccattttctccaagtaaagtaaagatttcgcctcttttgatttcaagagtaattccttttaatacgtcaagatcaccataggtttttgtaagatgatccacagtgatggctttcatagttatccctcattcctgattgaaaagtgtctcgtgcttgattttatctagctgatctacaagaaacgtccatttactccagaaatcttggaggtaaatttccccatttgcgttcaaacgataaaacttccttgccggtccaaggtcagatttccttttttcaacagttaccaattcttttttttctaaacggagtaagaccgtatagacggtgccttcgacgatatcttgaaaccctaattcgatcagtgtattcgtgatttcatagccataagtctctttgctgttatggatgacttgaagcacgacaccttctagcacaccttttagtaattcagtcattcctttcacatcgctcatcctctcaaaaaccatttgtctcaatacctagtattactcagcactgctacataataatacttagtagatggactgtcaactattaagtatcattaagcagagatgcaaaaaaaagtaacaccttgaaaaaagcttcccgcttagtggcgaatggtactcaggagactggatcctgttaaactgagctttattgtgggctgctctgcaacttcttcgttcgaatctaagtttgcagctaatcatcgaagacagtgattagctgctgctcgccgttgttatcactcttaagaacaagttcaacaagataggctctgatttgatgaattgtgttcagtaaagagaaataggacttcggtaccgatcatggtgtgaatcattgacatgaaatgttagacatcgattgagaagggagcaaaaaaaatcgagatttattgggctctgttatgaaactaaggattgtttcgttagggaatgccgctgatacataggcgcccaatgcacttgatttgactgagacagtaagcaagcctagactaaaagaggaaagctcacaattgctgctctttatgcccagtcggtggaaatgttctgccagatgttgagagaggctgtgtcctgctaaataacaaagaacattgaataaaaaatcgtctgattcagcatataagtgtatgaataaacattgatgtgatgaatcaggttatttttattaacaaattcttgaatctagaataaaaaaacggtaaaaataattttaatcgataaaaaatgttatttaattaacgtacaattttttaggttgttagatcagtgatttcctagtatctagtaaaaaactctcattttcgactcagcatatcgccattttacaaaacataatctaagcaaaataaccttgtaaaggaagccaaacgggaataaactggcatttgtgaattttcagaaaaatttctaaatttgttttttataaggagccagtaagtatggaaaaagaaaagactttcctaggacagccgcgagggttgtcgacactatttttcactgagatgtgggaacgattcagctactatggcatgcgggccatcttagtttactttatgtatgatgctgtaacaaatggtggcttaggcctgcctaaatcaacggctgtagcgatcatgtcaatctacggttcactcgtttatatgtctagtatcgttggcggatggatctctgaccgcttattaggatcgaacaaatccgttttttatggcgggatccttattatgtttggacatattgttctggcagcgcctcttggtattgctgcactatttgtttctatgatgttgatcgttattggaacaggtttgttgaagtccaatgtgtcagggatggtcggccacttatattcgaaagaagatgtgcgccgagatgcaggattttcaatcttttatatggggatcaatattggtggacttttagcaccgatcattgtgggtattttaggacaaaacgtcaattaccatttaggtttttcaatagcagctatcggaatgttcattggtttggtgcaatattatgttcaagggaagacaacgttgaaagatgttgcaacgacaccaactaatccattatctgcgcaagagaaaaaaatctttttccgtaacgttatcatcgtactagtgcttgtagcagtggttttcggcggtgcagctgcgatgggctatctgaccgttgatttctttatcaattgcatcagtatcttaggaatatttttgccgatctactactttactaaaatgttgcgttctcgtgatgtgacaccggatgaaaagaaaaaagttttagcgtatattcctttgttcttatctgcaatcgttttttggtccctagaagaacaagggtcatcaatattggcactttttgcggccgatcggacacaagatacgttgtttgggatcacgattccggcgagtctttatcaaacactaaatccattgtttgtcgtgctgttgacaccggtatttgtttggttgtggacgaaacttggcaataaacaacctagaacggaagtgaaatttgcaattggtttgattttagcaggtttgtcttttgtcttgttgatgttcccaagtatgctgttcggagtcaatcaacgggtaagcccattgtggctagtctttagtttctttatcatgattgctggcgaaatgtgtctgtcaccagttggattgtctgtaacgaccaaattagcaccaaaagccttcgaagcgcaaactcttgctatttggctattagcagatgcttcttcgcaagcgatcaatgctcaaattgctcgtttctatacaccgcaaacagaaggggcttattatggcattgtcggtggtgttgcagtagtcgtagggattattctttacatggcaagaaaaccgattcgtaagctgattgggaatattcactaatcaacggacttgatcttgaaaaagatcaagtctttttttgcacttttagtcaatttatgagaaaataaatgggaacatatgttccgtaggaggggttaaatgcacacgcgacgctataaaacgattctttcaccaaacaatacaatgaatctctatcgagggtgtacacatgactgtatttattgtgatagtcgcagcagctgctatcagatggcgcatcggtttgaagatatcgagatcaaagaagcagcaataacgattttggaccagcaattaaagaagcgccgacagccttgcatgatcgttaccggtgctatgtcagatccttacgttcatgcagaacagcgtttgagacaaacgaggcaagcactggaagtaatcaaaaagaacggttttggtgtcgcgcttttgaccaaatcaacgcgtgtgttggaagatttggatttgctgatagaaatcaaccagcaaacgaaagcagttgttcaaatgactctgacgacttatgatgaagcactatgtaaaaaattagaacgacaagtcgctaccacttatcatcgttttttggcgcttaagaggtttcaagcagcagggattcctactgttgtttggttatcacctattcttccttttatcaatgacagcgaggagaatctgttgtgggttttggactactgtcgccaagcgggagtgaaaagcatcatctgttttggatttggggtgacgatgcgggaagaaaatcgcgcatacttttatcagcaactagaccgtgattttcctggtatgaaggaaaagtatcagcaagcttttggcgatcggtatgtttgcgacagtccgaatcagcaaaagctaatggctattttttgtgcattctgccaaacctatcaaatcctttatcgaccagaagaagtctttgcctatatccatcgttttgaagaccagcagttgacactcttttaattcgcgtcttttaaacaaatgaaatagccgcaaggactgagagtgttccagtgtacgagcaacacctcgtcaccctgtcacgaggtgtgccagttctcttatcctgcggctatttttatttgatttttctgatatgcgattccttatggtgaaaaaaacgaacgtggtcttcttaaagagcctgccagtcgatgggctgccgcatgacctgctggtcgcggatcaacagcatgtcttggaaagtttgttttagaaaatagcggtcatggctcacagcaattaacgtaccaccaaagcgctgaatcaattcttcaatttcttcacgagcatagatatccaaatgattggtaggctcatctaatagcaggacgttgatttttttatgaaaaagtttcagcagataaaggcgaatcttctcaccgccagaaagatcctgaatgcgttttgagacatcatcctgataaaaaccgatttgtgccagttgttgtcgtgcagattgttcattgcctatgaactgataggcaaaggataggacccgcatagcgggattagaaaatgagagcttttgaggcagatacccgatctgcagattactgccggatttgatcgttcccgcgtcaagcgccaaagtacctaacaaaagctgaatcaaggtcgtcttaccggtgccattttcaccaatgatcgctaagcgctcaccacggtaaatcgagaaactactgtcttcaaagagtagccgatcagccatgactttaccgatatttcgggcgataaagacttctctgcctgttcgatcactttgattgactgtgcgtatcctttttttaggaggcagcgggggcttaacgagagtgatcttcgctaaacgcttttcaatttctttggctttacggaaaaagtcctcattgtccccttcattcccccattggcgataacggcgaatcatcgctttaagccgctggcattctttttgctgcagctcatagttcttagtcagttctgcgattcgagcttgtttcaatgaacgatattggctatagtttcccggataagaaatcaattgaccatcttcgatctcacagatcctagtcgtcactttgtccagaaaagcgcggtcatgagagatgacgatatacgcttttttcgtattgataagatagttttccagccaatgaagactagctaaatcaagatgattcgtgggctcatccagtaaaagcaagtcatgctctgtcaacagcaatcttgctagttctactttgactcgctccccaccacttaacgcctgcaaagaagtttcttgcaactgcgctattcccaatcctcttaaactagcaagaatccggtcttctaacagatagccaccgagttcttcaaattgtagctgtaattgtccatagcggtccaataatttcgataagtcagcgtcaggatcgctcatctgttgttcacaacgtcgcatcttgcgacttatctcttgcagtcggggggaagaggtttgtaaatacgtcagcaccgtttctgaagagggcgaaaattcttgtgccaaatgaccaatagaaagacttttacgtcggctgatcgttccagtatcatttttctcggtcccgagtaataaatctaataatgttgtcttaccagagccattgatgccgattaaaccaatcttttcaccgggatcaatttggaaagttaattgttcaaatagcggggtaccgccaaaatttttactgattttatttgcttgaattagcatgatctcactccttgagaccactcaaaaaggccatggaaatccatggcctgcgttatttttatctgatgttgttcgagataaacaccttgagatggccattgattttacgaatattcaactgttttagacagactcgtccctaaaacggtttttgtaaaaccaattgcatggctaaatgcgatatggtaacgctgataattgacgttacatgttattttagtcatgcgcatcatggtgtttcctccttttgcttatttgccaatagtgtaccgcaagtgaccttactttgcaattagtcagttagttttttcttgactggaacaatttcagaaaggttacttgccttcggttgcccaatcactaatggaacggtctcatggaccacgtcactgtaagtgagtccaaaccaacgttccggagaaatagtatgccgtttgataaagagtttggttaacattacttgccgctcccatcgggttaatgaggtgacattcgacaactcttcttcgatcagaacaaactggaagtcgccaacttgacgtcccggggtcaatgagtatttttgcggctgttttggtaagcgaccatccttcatcaattcttgaatgatttgtcggatgtagacattgacttcttgagaaacccgaaaacctaagtagagtttcaattttacgatgaaatctgtctcagccatcgagacttcgtactgttttgtataaggttcatctgtgacttccacattcacaaaccaataaactttggcgcgtttcggccgtttatcaaggatcgaataaataaactgacggccaatcgtatttccttgcagtttaggaactaaaaagacgacattggtctgagaaaatggcaatgtctcatcattccgcaattcctgtagttggggaatgtattcggtcaagtcaacttcttcggcagcttgttcttgaatgtggttgccccattcccaaatgagcatgatggcgataatcaaagcggccatcaaaaccgcaacgaacccaccgtggaaaaattttgcggcactcgagatgaagaagatgccttcgatagctgcaaaaaataaggtaataaatggagcgataaatcgcgcttttttgaattgacgcaaaaagaaatataacaagactgtggtcatcagcatagttactgtaatcgctaaaccataagcggcctccattcgcgtggatgtccggaataagagaacgacaccggaacaagcgatccacagcatcaggttaagcgcggggatatacatttgtccgatggaagaaccaggatacatgatctgcatccgcggcaacaaacgcaacttgattgcttccgaaactaacgtgaaagatccggaaagtaaagcttgggaggcaatgattgcagccaacgcagaaaagccgacgccaaaaacggtccaaccttgaggcaaagcctggaaaaaagggtttaggttttcaatctgttgataggcaggatcttgataaacctttaataaccaagcagcttgacctaagtaattaagcatcaaacagattttgatgtaaggccagctggcataaatattctttttgcccacatgtcctaaatcggaatatagtgcttcagcaccagtggttgccagaaagatattcccgagaatgaacagacctgaggtgttatcagggctaaacagcagcccgatggcataacgaggatccaacgcacgaatgacagacagatcaccggaaaagttgatcaaaccgacgatccccaaaaaagtaaaccaaccaagcatgatcggtccaaatgctttcccaacgaattctgtcccaaagcgttgcaggctaaaaagaacgaaaaggatcgttaatgtaatccaaacaataatggattgatcattcccaaaatgatcataaaacatcggaatgccccgcaacccttcaatggctgtcgtgacagtgacggcaggagttagtacaccatctgccaataacgcagcgccaccaatgattgccggaatgatcaagtagcggctttgcttacgaacaagtgtgtataaggaaaaaattccgccctcaccgtgattatccgcgttcaaagcgattaagacgtacttaatcgtggtaagcagagtcagagtccaaaaaacgagggagacacttcccaatacaaagtccggggagagtgttttcaacccgccgttgtcttcaacgattgctttcatcacatagagtgggctggtcccgatatctccatagaccacacccatggcgaccaaaaggcctcccgcggttaattttttcattttactcatagattttccctccaaattgaactgcaaaaaagacccaagaggccctttgccacttaggtcttgcaagaaacatcatagaccagcggattcccgcttgctgttgatctatgatcatggaaaaacccatgtgctactcccctaaattgctataattatctttgttttgctgattcctgtcaacttttttcatttaaaatgtaaataaacattttaaattttatgtttattcacgtaaaattacgttaagtcttatttctaagggggatagtaaatgattgaattgaaacatgtaagtaaaacgtacggaacaaaaaaagcattgaaggacctttctttgacgattcagcaaggtgagatctttggttttttaggacataatggtgcgggaaaatcaacgaccatcaagagtctagttagtattttacagccgacgagtggcgaaatcgtttttgatggcaaagcattagcccaataccgagaagaaataaaaaaacagattgcttatgtcccggattcaccggacatgtttttgcagttgaccgccggagaatattgggatttgatcgcagctgcttatgaagtaccggaaacccaaaaaaaggtacgcttaaatgaactgggacagttatttgatatgacgacgcatgcagaagaaacgctagccagtttttcccatggtatgcggcaaaaaaccattctaattggagcattactgccggatccggatatttggatcttagatgagcctttgcagggattagacccgcaggcagcgtttgatctaaaagaaatgatgaaagcacatgctgcgaaaggcaaaacggttattttctcgacgcatgtcttggatactgcccaacagctttgtgatcagttagctattttgaaaaaaggcgaattgctttataacggttctgtcgatgaattgcttgcacaaaatccagatctttctttggaagcgatctatttaaaaatgacaggtagaggcgcggaagagccatcgttgacagaaaatggaggcgagttcagatgaacaagcgacagttattgacgttgacaagcgtcaatcttcggtacgccaatccgcaagtcacagataaagcccgtaaaaaaggaaaaagcgggacacaattgactcgttatttgatccaacaatatgtattatcaggtttcgtttttttagtgatttacggtctaacaatgatcgcactggatttcagccgtttgccaggttttttcacttattatgttgctctttttggcgttctaggattttctcaaggaatctcgtccatttttaatgtcttctttgagagtcaagacttgcctgcatatttgccattgcctttccggcaagcagaaattttcaccgccaagattcttgttgtctttttaacagtggcaccatttgtttttccgttatttgtcttatttcttttaacaggaatgcgttcacaggtctttattctgctcacgcttttgttagcgattgtgctctttttattatttctcgtgattgtttttagtatttgtagtttgatcgtttttggattagctcgaacaaaattgtttcgtgaacataaaaaaatgatgaccagcttgttgttgggaatttctatgatcgtagtagtggtagggatcttgatgatgaatcaaaccagttcctacgatacacagatcatggatcgcggggccattgcctttttactgccatttttctatatcatgcacagtccctttgcagttgcaggaatcgggagctttgctattgttctagtggtttgtttgttgctgctaggagcgattcggttctttattttaccgaagttttatgatcagatggcgatggctgtgcccgaccatggaagcgtgcgacggaagcagaaatccgggcaaggattgtcgcagatgttattcagttataattcccagctggttcgtgatcccaacttgattatgcaagtattgtccacttcactgatgacaccgatcatttttattgtgacatttgcattgagcggtacgtttgatctaggacaaatggatgctcgtttttgtggagtgttctttttggcaggtatcgcattagctgtgatgatggtcaatccaacctcttttatcagtaccttgatttcattggatcagcaaaattttctgtttgttcgttcattgccgttgtctatgaaaaaatatttacaagcaaaattccgatttggcctaatgcttcaaatggttttgactggcgggattgccttattggcgattttgctctttaagatgccgatcctattggcaacgactttctttctaggtacgttacttggttgttacttgctatgcttaaaatattttgcccgtgattatcgcttgcttttgcttgattggaccaatgtcagtcaattgtttacccggggtgccggaagtgtgggaatgatcgtcggtatgatggtggcacttctccttagtattctgttactcgtcggttacggttttgcagcaacgatgattccattttggctcttgaatggtccagtcttgctagttctgttaattggtagcgtgctatggcacaactactatcaaagaaaattttggcagttgattcactgagtctagtcgtcatcaatagcgcatagaaaaagaaatagatttaatcagaaaattcagaaaaaagactttacaagtattcagaaacatgattagataataaataacctattactttgctttcattttttgctggcaagcttgctccacaggcttgttgcaagagactgtgccaaacgtcatactgattagaaggaaccagaagttgtccgcttcaagaaagacagctgggtcattttgagctgagacggatggcgcagtttttttaatggctaaaactaacaaatcgtgaaaaatagaaaaaaacactctgacaagaacctttttgtcagagtgtttttgtttttgatttgagtatgtgttggttcattcagagattatgcttcctctttttcgttggttgttggcagatgattgtcaaggtctgtccgtacgaccaatacgtcacaagaggcatgacggattacatactcagagactgaaccaataaaaattcgttcgacggcattgagaccagtagcgccgatcatgattaaatcgatttgattatcttctggtaattgtttcgcaatgattggttttggcgaaccgtattcgatgacagtctttactgcagttacttggttcttacgggcatagtcttcataatctttcaatgtttgcttagccatttcagtcgcttgctcagccaacatgccatcaaaggaagaaacagtttgaaaggcacgggtatcgattacatgggctagtaccagttcagaattgttccgttgggccacattgaccgcttttttaaaagctaattctgactcacttgagccatcgactgcaaccatgattcgttgatattgttgtaacatatgaaacactcctctcagataacttcatctttattgtaaaactttttgactaaaaagaaaaacctaattatctgtttttttcatcttacgggcaaacagcaaactgaatgaggcagaagtaatcattaacactgctaaataaacgagggcaatcaattttttgtctaaaaaagccacgatgattgcaagaatacctaaaacaccatgaagatagccataaatggtcaaaaaagtttgatttttagtattttcaggaataagggaaaagaaaatggcatgttttgttaacagtaagtagcagacgccaaacaacaaaacagcagcaatcaaaaataatagaaaaatcatccgtgaaatccgtccttctcttataagatagttttagtatagcgaagtgctaaaggaatagcaaaaagcacaaaaaagccatctgtctaaaacagatggcacattcaataaagaatgggtaatatccgtagatgccgttctttttcccgtagtattgatcccgcaaattctagcaggtgggttccacggtctaagcatcgaactaccaaatgaaaaggcatgttaccagctttgacacaagacggatcccaatatatcaataaaaatgttcggtcaacacacagatgggacaactcgtacatcacagaattcccaccttcatagtagcataggacaacaaaagtagcaataaagaagattgaaaacggtgacagaaacctttttcgcttccatgaagcggctgccgagggttaggtctgtttttttcgttgctgcaattgttgatatctttgacctagagcttgctcgtattttccggtagcctttggctgataatagtgagcttgcttgattttatcgggtaagtattgctgatcgacccacgcatcatcaaagttgtgcgggtattgataaccgacgcctcggttcaaggcttcagctcttttgtaatgactgtctcttagatgatcagggacatccccggcattgcctgcacgaatatctgcgatggcagcgtctagtgccatataagccgagttggacttaggggatagacaaaggtcgaccacagtatctgctaaagggatcctcgcctcaggtaagcctaatcgttccgctgctaagacagcattgactgttcgagcagctgccgctggattggccaacccgatatcttcataaccgatcaccatcaaacgccggcagatgattgccaagtctcctgcttctaccagacgacccagataatggagtgccgcatcaacatcactgccgcggatcgatttttgaaaagcagagatgacatcataatgggcatcgccatctttgtcatgggtcaatgctttgcgctgaacacactcttcaataattggcaaagtcaaatggattttcccatcagaacttggcggcgtggagcgagcagcgagttctaatccattgagtgcactgcggagatccccattggtcgctcgtgaaagatggagacgagcttcttctgtcaactggatcgattctgttcccaagccacgttctttatcagctaaagccgcatcaatggcggctaaaatatctgattcttgcaatggttttacttcaaaaatctgtgtacgactacggatggctgggttgatagtgatataaggattttcagttgtggccccgatcataatgatttttccgctttctaaatgaggcagtaagaaatcttgctttgttttatccagacgatggacttcatccaaaagtaaaatgactgtgccgctcattttggcttcttcggcgacgatttgaaggtcttttttcgtatcagtcgcagcattcagcatgcggaatgcgtaacgtgtcgaaccggcgattgcactagcgatacttgtttttccggtccctggtggaccatacaggatcatggaagagagcatcttggtctcaaccatccggcgaatgatctttccgggtccaactaaatgctgttgacctacgacttcatcaaggttgcggggacgcatgcggtacgcaagtggttgctgcataataagctcctttcttttttctttagtatatcataagaacgtatattcccataaggaagcgggtattttgctattgaaactagtcagtggcgatagaaaggtcaaacaattgataagatggtcgtaatcaatagtaagttccttgagaattgtgtaaaataaagaaggtgaagaaaatgaatgaaattgaacaattatttgcacaacaatcaacaacagcgattgcccggcaattattagggatgtatctggaacatgagacgcccagtgggaaattaggcggttatatcgtcgactgtgaagcttatttaggaccagaagatctggctgctcatagtttcgggatgcgtaacacgccacgagttcgagcaatgtatgaaaagccgggaacgatttatttatatacgatgcatactcatttgattttgaattttatcacacagcctgaaggcattccccaagggatcatgatccgcggcgtggagcccgtcgaaggaatcgcacaaatggagataaatcgcagtaaatccggtcctgatctctcgaacggacctggaaagctcgtgaaagctttgggaattacgcctgattattatggccattcaatttttacaagtccactgcatcttgtcaacgagaaacggcgaacaccgaaagaaatactcgctgttcccagaatcggtatcccgaataaaggggagtggacccataagccgctgcggtttgtcgtagcaggtaatccatatattaccaacagcagaaaatctgctgtccagccagatcacggctggcaataggaaagaaggaacgtataatggctaaagaaacaatgctgacttatttggacagacaattaacaaaaaaaatccctgagtacgatgttgcccttgattgggatgcaagaaaccataccatcgaacttgttttacgcttatttgcagagaacccgaatcatttgcaggtagatgatgcccaaggagtagcctctgaagaagagatcatcgaatttgaagacggtattttattgtttgatccccaaaagtcttcctttgcagaagaggactttttggcagtcattccctacgcaggcaaaaaaggaatccaaaaagcgttgctggatgctttggttgattacatcaaagagattctgacggagggagaaagtgatttactagattttctaaacgatgagagtgaagaagcggtcttcgaactagttttcgatcaagatcagttgttagaccgtatgaatacttaccaagaaagcgatggggaatcgtatattccttatccaagttattaaggagcagatagatgaaatggaatgaagtgaaagtagctactgcaagtgaagcagttgaagcggtcgccaacattttgatggaacaaggggccagtggtgtagcaatcgaagatgttcttgacattgaaaactttaaaagcgatgcctatggtgaagtgttagacaaagaaacctatacaacgctggatgaaggcgcccaggtaacggcttatttccccgagactatctttttacctgaaattttgccatttattgaggcggcgatcgctcgtttaccggaatatgggttagcaattggcaaaaatgagattacctccagcgaagtagtagaggaagagtgggcgactgcttggaagaaatattatcatccagtacggatcactcgttatttgacgattgtacccagctgggaacaatatgaaacgacggaccctgccgagaaaatcattacgctagatccaggaatggctttcggaactggtacccatccgacgacgcgcttgacgttacaggcgttagaaatgtatttacgaggcgaggaaacggtcctggatgttggaaccggatcaggggttttaagtattgccagccgccacttaggggccaatcaagtatatgcctatgaccttgacgaggtggctgttcgggcggcaaaagaaaatatggcactaaacccagttgccgaagcagtgaatgttgctgccaatgaccttttaacaggtattgaaatcgaagcagacattattgtagcgaatattttagctgatatcatcttactgatgatcccagatgcttggcggttgctgaagcctaccggaacattaattgtttctggaatcatcgaagcgaaaaaacaacttgtgatcgatgccatgacagagcaaggatttgttgttgaccaaatcttgaatcaaaaagattggtatgcgatcgcactaaaaaaaccagagtagggaatgtcatatgcagcgatattttttgaatgaggattatgaggcgaagcctgtttatgtagtagagggagaaccgtttcatcacatggtacgtgtgatgcggatggttccggatgattgtgtctacttggtctttcaagaccaagtagcgatcctcgcgaaaatccagcagatcgatgaacaagcggttcatttgattgaagtagaaaaggaacagcaagacaaagaattaccgattcatgttacgatcgccagcgggtatcctaaaggagataaattggaattgatcgtccaaaaagggacagaattgggtgccgctaaatttatcggttttcccgcccaatcctcggtagttaagtgggaccataagaaactccaaaagaaacagcagcggctgcaaaaaattgcccaagaggctgctgaacaagcgcagcggcaacgagtaccgatcatccaactggctgcttcggacaaagagttgtgggatagtctttcaaactatgactatgtgatcgttgcttatgaggaatctgctaaaagcggcgagaatgccaaactgatcgatattttgtccaaagcagcgcccggcagcaaaatcttagcaattttcggacccgaaggtgggctgacacctgctgaaatcactcgtgctgaatctcaaggtgctgtgatctgtgggttagggccacgtattttgcgaaccgaaaccgccccattttattttttgagtgctgtcagcgtactaactgaattagtaaggaagtgatcaagtgacgcaattcaaagacaagcttagttttcgatttttacaagctggactgacggattggttgttaaaagatacgtttactgaatttaacacacttggtgtccaagaagtcatcgtgttgcctagtgatttgcgcagagcgaagcagttaactgaaggctccgagatccaagtcggctgtgcagttgattttcccttggcacaaggaacaatcgctaagaaagcttttgagatcggtcattcctttatggatggcgctgattttttagaagtctggctaccagcggctttgttggtggaaaaagagcggacggctgatctggcggagttaatggagacaagccggtcactggctttgtctggtggtgagatccgctgggctgtcaatacttcacttatgaatgagttgacaaagatccaagtagcacagcgtttgaaagcatgggactggcctagtattactcttggtcagcagttaactgtttcagatgcgttgcatgatgtctcgatttttgctttagatggaggaccgcaactgacgatccaagtcaacacggcagcgtctgttacggatcagaaatcacttgcagaacttttacaggcaggggcggcaaaaatcggcgtgccctttacagagtcagcgttactgttgaatgaataaaccggtattttgtctcgcttgaccagaatagagagaattgaaaaaaacaagaaaaatttgtataatgacactaatcataaaagaagatggccaggcagaagcgcattgcttcaagagttctgctattcagagagttggggatagcagaattctttagaagcggcttctgtcttgctttttgaaaataggaaaaaaggaggcgcgtttcatggcaaaagaagtgatattatccggacctggtgtgatcaagctcgtggcccattatatgagtgaagaacatgttgcatttgtacagaaagctttagattatgcgacagaagcccacaaagatcagtttcgcaagtccggcgagccttacatcatccatcctattcaagtagcagggattttagcggaactacaaatggatcctcatacagtcgccactggttttttacatgatgtggtagaagatacggaagtgaccctagcagatctaaaagaagtctttggtgcagatgtagcgatgctggtcgatggtgtgacaaaattagggaaaatcaaatacaaatcccatgaagaacagctagcagagaatcatcgcaaaatgctgatcgcgatggctcaagatttgcgcgtgatcatggtcaaattagcggaccgcttacataatatgcgtacattgaaacacctgcgggaagacaaacaacggcgaatcgcccaagaaacgatggagatttatgcaccattggcgcatcgtttagggatcagccgtatcaagtgggagctagaagatatttcactacgttatttgaatccacaacaatattatcggatcgttcacttgatgcaaaccaagcgggaagaacgggaagcttatgtgtcggaaaccgttgaacagattcgacttgcaactgaagaactagatatttttgctgagatctatggtcgtccgaaacatatctactccatttaccgcaaaatgaaagaccagaagaaacaattcaatgaaatctatgatcttttggctattcgggtaatcgttgattcaatcaaagattgttatgctgttttaggaacgatccacacaaaatggaaaccaatgccaggtcgatttaaagattacattgcgatgcctaaagcgaatatgtatcagtcactacatacgacagtgatcggtcccaaaggcaatccagtagaaatccagattcgtacccatgagatgcatgagattgctgaattcggggttgctgctcactgggcatataaagagggtagaaccgagaaagtcaaagcagacaaaatgacccagcaagtcggttggttccgcgaaattttggaactccaggatgaaagctacgatgcttctgaatttatggaaggtgtcaaaggggacattttcagtgacaaagtatatgtattcacaccgaaaggcgatgtcacagaattgcctcaaggttcaagtccgctggattttgcctacagtattcataccgatatcgggaacaaaaccactggtgcaaaagtgaatggcaagatggtccagttggattacaaattgaaaaatggcgatatcattgaaattttgacatcaccaaattcattcggaccaagccgcgactggatcaagcttgtagctaccagcaaagctaaaaacaagatcaaacgttttttcaaggcccaagatcgtgacgaaaacatcatcaaagggcacgaagcagtggtcaaaacattgcaagacatgggctttgtaccaaaagaatttttaacgaaaagcaagatggcagaagcctgcgaacgatttaattatcaaacagaagatgatttatttgcttctgtcggttttggcgaagtgagtccaactacactggccaatcgtttgacggaagaagaacgccgtgagaagcagatcgaaaaacaaaaacaacaagtacaagacatgatcaatcagccagcgaagaaagaaccagagaaaatgaaagtccgccatgaaggcgggatcgtgatcgaaggcgtggacaacttactgatccgaatctctcgttgctgtaatccagttcctggtgatgccattgtcgggtatatcacgaagggccgcggcatctcgatccatcgcagtgactgtccgaatgtccaaagcaaagagatcgtcaatcgtctaatcgatgtcgagtgggaagatacttctaacagcggcaaagaatacgatgcagatctggaaatctatggttatgatcgttccggattgttgaatgatgtcttgcaaacagtcaacgctgttactaaacgattggtcagtgtggaagcgaaaaccaacaaagacaagatggccaccattagaatcacggtctcaattcagaacctaacacatcttaagtcaattgtggacaaaatcaaacaaatcccagaagtatatagtgtcagaagaacaaaggggtgagacgcgagacatgcgagcagtcattcaacgtgtaagtgaagccagtgttgcaatcgatggaactactgtaggagcaatccaaaaaggttttttagttctcttgggaatcactcatgaagatagccaagaagatgtggattacttggttcgaaaaatcaaaaatttgcgggtgtttgaagatgaagcgggaaaaatgaatcaatcgattgaagcaatcgaaggtgctattttgagtatctcgcaattcacattgtatggcgagaccaaaaaaggaaaccgtccaagctttattcaagctgccagacctgaagtggctacaccattgtacgaagctttcaatgcgggtctgcacgctgcaggtatcgaagtggctacgggtcgctttggcgcagacatgcaagtgtcattaatcaatgacggtcctgtaacgatcctgatcgatacgaaggaaaaataggctgcgttcacaacgactgcctatccaacatgccaaaagaaccaaagcaaatagtttaaagaggactgccaacatgcaagttggtagtctttttttagtggaaataagtccatcttgtagcacttctggtaccaacccttttgtctttggactatcttacaaaactgtaagatagttctttctgatcagaaatagttatttaagagctgaatctattccttttcgtaatggtagcagttacaaaaaagttatttatttttatccatccctaaaaaactttcaataaattagattgtccttaaagcgcaaatgtgaaataatagttaaaaaataatgtcactggaggaaatgacaatgaatttttggcagcgtgcattaaaaagtgttactcgcaggaaagggaagtcgtttattttatttttagtcatctttattttaggtaacgtgatcgcaggtgcggtagctgtgcagcagtctactatgaatgtggaacgggaaacgaaaaagaaaatgggcaacgttgctacagtcgagtttgattatgagcagtttgagaaagacaattcaggaaaatcagatgaggaagtttattctgaagaaaatagtccgaaaacgccaaaaacggcggactatgacaaagtgggagaattagattacgtcaaatattacgactataccatgatgggttggttagagaccaagaaattcaaagcctatacaccagaagatgaatcttttggcatggcgggcggcaattattttaatttaaagggcggcaatcgaccacagccattagatatggaagaaggcaacatcaagctgatcgatggagaagtgtttagtgaaaaagacttgtcagaaaccactaactcgattttgattagtaaagaagtcgctgaaaaaaataatttgtcggttggcgatcaatttgtttgggatatgtatagtgaagtccctcaagatccgatgggtgacagtgatgatagtacggctacttcagatgatgaagatgcagagagtgaaagtgcagaaatccaaacaaaagttgtcacagctgattatcctgtcaaaattgcagggatttttagtgtagttaaaaaggaatcggccaatagtaatccttcgcaagaagaaaaatccaatcaaatctggcaagctgttgaacagatcaatacgatttatgctgccaatcagttggtgaaagattttagtaaattccaaaacgaaaaattgtggggagatacggtaatggccgaagatacggaggccgaaccggaagagtattatcaagcgatgtatgttttgaactctaccgacgatgttgaagcattcaaacaagaagccaatccattattaccagattactatcatgtggtagcttccacagatcaatacgatcagattgccggaggaatgaatcgtctgggaacgatttcccgctatatcgtgattgttgctgctattgctacggtctttatcatttcattagtcgttctattgtttttgcgagaccgcaagcaggaattagggatctatctatctttaggagaaggccgtgggaaagtgattgggcaaatcgttattgaagtggtgctcgtcagcttagtcgctctaatctgctcattggtgacgggaaatctattaggaagtgcggtttctcaaacattgatgcaaagtgactggatgacgaatctgtcccaaacggatacctattccatttcaagcacaatgatgacaaatactctcagctatgcggatgtccaaagtgcttataaagtcactttttctatggggtatgtcatcacctatcttttattgggattaggtacagtcttattgtctgcaatcttgccgttgttgtatattctacggctgaatccaaagaaaatcatgatgtagggggaagaaaaaatggctttgttggaaacaaaagaagtagattactattatcaagatggcgatcagcggcgctatattttgaaagaaacatcggtggcgtttgaaaaaggcaagttttatgccatttcaggacagtcagggtcaggaaaaaccacatttctctctttgatcagtgcgttggatacacctaaaagtggcgctgttttctttaatggagaagatattcaaaaaatcggacatgagaaatatcgccgagacgatatcagtatcatctttcaaagttacaatttgattccttacctgtctgcggtagaaaatgttctagtcccaatgtcgatcacggataatcaattgccggagaaccagcgggaagtcgcatacaatttattggactatattgggatcacgaaagaaaaagcagatcgtttagtcaatcagttgtctggtggggaacagcaacgggtggcaatagctcgtgcactggcgacgaatgttgatattattttggcagacgaaccaacgggtaatttagatgaagaaatggaacaggaaatcatcgatatttttaaagatttggctcatatgcataacaaatgtgtgattgttgtgacccatgcgaatgaaatcgcccaacaagcagacgaagtactctatttgcgtaaaggtgtgttgaataaagatgagtgattttttatcaaatttcagtcctggtaattacgatggcaagaaacaaagctctcctaaagaaactgagtttgacgaaaaaacagagcgtaaagcagaaccaattccagattctcagacatctgatcagggcgcaggagagagtaaagctgcagcagcatcggatccgaaggaaatgaagcgaagaacgcgcaaggaaactagctcttctcaaccggtcagtcggttcggaaaagaagagacagagtttgatccaacttatcgcaagcggcagcgtaaaaaatacgcgctgatcgctggtgctgtcattgtgctgattgccatcagcagtgtggtgtattatcaattgactcatgtgaaggttcctgattttgctaagaaagatttatccgaagcccgaacatggggcatggaagaaggcgtggcgatcaaagtcgatcaagtgtatgattttgaggtagagaccaatcgaatcgttagtcaaagtgttgctgcagatcagaagatcaaaaaaggcaagactttgacagtcaaagcaagcctaggtcctgacccagaagaaatgatcgagctgcccgacttttcgtcactgactaccgaagcggcaaaagaatggatcgagaaacaaaaggcagaaaatatctcgttgatcgaacagtatgacgacaaagtcgaagcaggtgtattcatcaaacaagaagcagcaaataaagagcaagatctcaaagcttataagcgcaaagatcgcttaagcatctattattcaaaaggaaaagaagtcttcgagaagaacatcgaagttactgattttacagggaaaaacaaaggtgaagctcaagagtgggctaagaaaaatgaattgaagtacaaagaagaagctgttttttctgatacagttgctctagacgtcgtggtttcccaagaaccagtcaaaggcagcaaattggccaaaaaggatcaatttcttgtcaaagtttctaaagggaaagcattagttgttcctgatttctcacagtataccatcgagcaggcagaggggctagaatcgaagataccgattcaagtcaagacagtttattctgatcaaatcggttatggcaatttcatcagtcagtcggaagaggcgggcaaagaatatagtgacagcgatacattgccaacagtgaaagtggtttattcactggggcaaccgtatttgaaggatatccggcaccaagcaacggaaggcgatctgccaaaaatgttctttgatgagtacaaatcgaaaggtgcttctgtatattatgatgtctactatgtagattcagcagaaccaaaaggaacagttgtggagatgagtcgttatggtgaatttattccattggaagtatcgatcaccatcgggattagtcgcggaaatctgcaaggcgagaccgaatcattaccggtcagtcctgagacagaaaatgtaaaggatccgctagaaacagtcaacagtgccactaccgaatgagacatttagcaatcgggcccgtaacaaagctacagaacccaagcaataagtgagtgaactatctaaatgaagtgtgtcttctgtttgtcgacaatgacagactgaaacagaaggatctacctgcatttagatagtttttctttttttttacttggattttgaaaaatggagagagtttttttgttatcaagtaatcacaggttttcaagcatgcatgcttgaaaaccttttatcgatacggtacagttgaattgataaccagtcaataagcagtattttacatagagaagggacgaaagaaatgatcaaaaaattactagcaaatgttggcgattataaaaaagccagcctattgacaccggtctatgttgccggcgaagtggcgctagatgtcattatgccactgatcatggcaatgatgatcgaccaaggaattgaaaaaggacacgcgggcgtcattttgcgctatggcggtctgctttttttgtgctcattattggcactgatgctaggaactttaggaggacgaacagctgcgattgcttctgccggttttgctcgaaatcttcgccacaatctttttagcaagattcaggatttttctttttccaatatcgaccgtttttcttcctctagtttgatcacgagaatgaccaccgatgtgactaatgtgcaaaatgcttaccaaatgattatccgaatcttggtgcgcagtccattgattctggttttctcactgatcatggttagcacgatcagtccagaattgatgctggtttacctagtcgtcttgccaattctagccatcggacttgctttagtgattcgctttgctcatccgcttttcttgaaagtatttcggatctatgaccgtttgaacaacgtagtccaagaaaatcttcaaggaatccgtgtggtcaagtcctacgtcagagaagagcagcaagaagaactttttgacgaggtgtcaaatgatgtctaccgcaactttacgctagcacaacgaatcgtctcgttcaatatgcctttgatgcaattctcgatctatagctgtatgttgctgttgtcttggttcggtgcccaactgatcgttgagcacagcagcttgacgacaggggaactggttagcatgttcaactatactatgcagatcttgatgagtttgatgatgatgtcaatggcatttgttcagattctgattgctcgtacttccgcacagcgggtggtggaagttttggatgaagaaagcgacttgaaaaatccggcatcgccattgacagaagtcaaagatggttcaattgtctttgaaaatgcttgtttcagttacgcaaatgatcaaacgagattggcattggaaaatgtcaacttacgaattgaatccggagaggtaatcgggatcatcggcggaaccggaagtgcaaaatcaacgctggtccaattgatcccccgtttgtacgatgtcattgacggtcgtgttctcgttgggggacaagatgttcgcgcctatgatttggcagcattgagggatcaagtcagtatggttttgcaaaacaatgtcctttttagcgggacgatcagtgagaatcttcgctggggaaacgcggaagcaacggatgaagagattcagcgggtagcaaaaattgcccaagcggatccttttatccaagaatttcctgataaatatgacacattgatctctcaaggaggaaataatgtctccggtggacaaaagcagcggttaacgatcgcgcgagcgctgttaaaaagaccgaaaattctgattctggatgactctactagcgctgttgatacaaagacagaccgtagtattcgagcaggattgaaacaagaaatcccgggaacgacaacgatcatcatttcccaaaggatcaattcgatcgaagatgccgatcgaatcattgtgatggatgatgggaaaatcaacggaatcggaacccatgaagaattattaactagcaatgaaatttatcgtgaagtctacgactcgcagcagaaaggatttggtgaaggtgaagaatagacaagcagcaaatccccagagaaccttgaaacggctgctggcgaccatgtttggcgattacaaactgcagttgattatcgtattgttcatgatcttgttaagtgcttttgccaatgttcgcggctcactttttttgcaagtggtgatcgatgaccatatcactccgctgctgggacaaagcaatcctaacttcagcggactgctggcagctattattcagatggcaattatttatttaattgggatcattgctggtttgacttacaactttatgatggtcaaaatcagtgagggcactcagaaaaaaatccgcgatcagatgttcaaacatatgcaaaaattaccgattggttattttgatggccattctgatggtgatatgatgagtcatttcaccaacgatacggatacattacggcaaatgatttctcaaagtattcccaatttgatgatggctgccgtcacattttgctcggttttcattgcgatgttttccattagtatcccattgacttgctttgtactggtttcggtcattttgatgctgaatgtgattcggatcatctcccgcaaaagcggccgcttctttggcgcacaacaacgggatctaggcgcagtcaatggctatattgaagaaatgatgcatggacagaaagttgtcaagatctttaaccatgaacacgttgtcatgcaggaatttgatgctttgaatgaccagttgcaatccagtgctacaaaggccaatgtcaatgccaatacattgatgccgatcatgatgaacttgctgaatgttcaatacgtgctgatcgcaattatcggcgggctctttgccatcaatggtgtctcgggactaaccgtagggatgattgcttctttcttacagcttagccgttcgctgaatggaccgatcagccaaatttcacagcagatcaactttgtgatcatggctttggcaggtgcagaacgtatttttcatttgttggatgagaccccagagattgatacagggtatgtcacgctagtcaatgccaaatgggaatctggccatttagtggaaacaacaaatcgtacaggactctgggcttggaaacatcctcacgaagatggaactgttacgtacacagaattgactggagatgttcgttttgaagcagttgattttgggtatgtggatcatcaaatggttctgcatgacatcaatctttttgctgaaccgggacagaaagttgcttttgtgggagcaacgggagccggtaagacgaccatcactaacttgatcaatcgtttttacaatattcaagagggaaagatccgttatgatggcatcaatattcaaaagatccaactagaatctctgcggcgctcattagggatcgtcttgcaagatacacatttattcacaggaacgattcgagaaaatattcgttttggtaaactggatgccacggatgaggaagtagaagcggcagcaaaactggcgaatgcggatatgttcatcaatcatttacctgagaagtacgataccgtaatcacgggggatggcgaagggctgtcgcaaggacagcgacagctactagcaattgccagagcggcgatcgccgatccgcctgttatgattttagatgaagcgacttccagcattgatacgcgaacagagcggatcgtccagtctggaatggaccggctgatgcaaggtcggacagttttcgtgatcgctcaccgtctttcgacgattcagaattcagatgtgatcatggtgatggatcatggtcgaatcattgaacgaggtactcatgatacgttattagcagagaaggggacctattaccaactgtatacaggaaaaattgagttagactgattttttcccaggaaacgaagaccggatttaagggtcttcgttttttttcttgctgctgtgctatactaaagaaaaactatgaggagtaagtggatagataggaggaaataggatgcatttaacggtttcacagatccaattgaatgaggaaatgtatgaactgggtgtcactgatcagggggctgcttattttggtcgtttagcagaacatgcagagttggctctttttttcccatatgcagaaattcgtgaatgttctcagacaccagaaaggtttgcaaagccgctgaaagcctatttcgccggggagccagtagccttcgattttccttttgactttgtcggtacaccgttccaacaaactgtttggcaagcgttaactgaagtcccttatggaacgactgtcagctatagtgaattagcggtgagaatccaacgtcctagtgccgtccgagcggttgccaatgctgtcggacgcaatccgatgatgattattgtcccttgccatcgtgtcctgggaaaaaatggtcgattgactggttatcggggaggtttgccgatcaagcggaaattattacagctggaagggattcctttcaaggactgagcgcattttttctgcaaaaatttactaggtcttcttctcgaatttagtgcttcataaattgtttgtttaaaagtaaaaaatactaaaaaggcgtttctttttatgctacctttgatataatggagttgtttccgtttacaaaaaaggagtggagaagatgaagcgaatgaagttgcaaaatggttcagatatccgtggaatcgcgctttcgacagcagatcttacagcggatttaacagaagatgcagtgaaagaaattgcttcaggtctgcggacctggttgctgcagcgatatacggaacccttaaaagtggcagttggtcgtgatagtcgtttaagtggtgaaacgctgcagcaggcgtttatgaaccaattgcgaatagaagggattacggttattgattgtgggctggctacaacacccgcgctatttatgagtacccagtttgctgattttgattgtgatgccggtgtgatgctgacagccagtcatttgccctattactttaatggaatcaagatttttagtaaatctggtggtgcagaaaaagaagatatctcgtttatcttagcacatcctgaagctcatccggctgaccaactcggcgagtattaccaacgagacttacttactccctatgcagcagatatggtgacgaaaattcgtcatgggatgcagacagaagaagaacagccattggctggaatgaaaatcattgtggatgctggaaatggcgcaggtggtttttttgcagagcaagttttagtgccgttaggggcagatacgaatggttcacagtttctggagccagatggacacttccctaaccacattcctaatccggataataaagaagcgatggctagtattatggaagccgttttacgagaacaagcagacttgggaatcatctttgacaccgatgtcgatcgatccgctgtggtgaccaaaagtggacagccgctgaaccgcaacaacatgattgctgttttaagtaaaatcgtcttatccgaacatccggctgcgagtattgtcacgaattccccgacctccactcatctaaagacatttattgaatcgctaggtggtcatcaagtgcgttatatttccgggtatcgcaatgtcatcaacaaagcgatcgcccttaacgaaaaaggcattaatgctcagttggcgattgaaactagtggacatgcagcattcaaggaaaactattttttagatgatggtgcatatgttattgcgaagatcttgatgttgctgccaacacttcgtgcgcaaaatatcagtttggaagacttgatcgcggcgctgaaacagccagttgaaacccaagaattgcgtttcaagatcaatgattcagattatcgcgcaaccggggagaaggttatcgcatcgctagcgcatcatctcccatcggggtggcagattgacaatgaaaatgaagaaggcatccgtatacaggtttctgcaccttatggacaagggtggtttttgttgcggttgagtttgcatgaaccattattggtcttgcagatcgaaaatgaccaacctggacatttgccggcgatcgtccgcgaaatcagtgaacgtttgctgccgtttgaagcgatcgaccagtctgcaatcaaacaatttttagaaaaataatgaatagagaatgaagggttaatgttggtatttattatgttagtgatcatggctgtcacttatggtgtgaatctttttctgatagcatacatgagaaaacgaccgcagatcgatgtggtagaacgattgtctatgttactgggcgtcaatatgagtgtcttgtttgtagatgggatcgttttatttgttggaaagttattattagaagcagcgatgattattgaatagacaaagaaactcttagagagtcagagaaaaggaacttttttatctggcggatttgagagtttttttagctttttttaaagctgggattatcattcgctttcgatttagatatttgttaaagtaaagaaaagaagtggaggggaatattcagatggcaaaaatcatggtagtagaagatgaagcagttattcgccagctgatcatcgaagaacttgaaaaatggcaattcgaaacatttggaacaactgattttcatcaggtttttgacgattttgaagagcaagaaccgcaattgattttgttggacatcaatttaccggtttttgacggctattattggtgccagaaaatcagagagacatcgaaagtaccgattatttttatatcaagccgtaatacgaatatggatatgatcatggcgatgaacatgggggcagatgatttcgtgacgaagccatttgagatcgatgtcttgattgcaaaaatcaatgcactgctgcgccgttcctataactatgtcgaaaacaacagcgaaacgctggttcacaatgggcttactttgaatatcgacaacagcagcatgcagatcaatgatgaagtaattgatttaagcaaaaatgagtatcgattgttatatatattgatgaagaatcacgggaagatccttagtcgagaaaagctgttgcgagcgctctgggatgatgaacgttttgttgacgacaatacattgactgtcaatatcaatcgcttgcgtcggaagattgagcaagccggtatggataattacatcgaaaccaaagttggacaagggtatattgtgccatgaacaaaccgatgtcattcattgccttcttaaaagaccgctggttacttctgattggttgggtgatttttttcttgctgatgattctagtgatgtggctgacacctgatttccccatcgactggggaactgttggctatctttttttgatggaatcagtcgttctactgctttttttgggcgttttttatattactaaacgtcgtttctggcaaaagctcacattccatgagtcagacagtgtcttacaaaactatattcatggtgcgcgttcatcagaggaagaactggttcaaaactatatcaatcatctgattcgcgaacaccaagacttgatgcagcaagtgataagcaatcaagaagagcaaaaggaatacattgattcttgggtccatgagattaaagtacctttggcagcgacgcgcttactgttaaattcgattgaatttgatattccagatgaaaagtatattttactggaaaacgaagtgaatcggatcaatgagtatgtggaacaagtgctgtatgtggcacgtttggacagtttttccaaagattaccttgttcaagaagtgtcattgaaagcgacgattcagccggttattcgcagtcaagccaacgtgttcattcagaagaatattcactatgcgattaaagggggagaccagcaagtattaactgacggcaaatggctgagttttatttttcggcaaatcctcagtaatgcattgaagtatactccggaaaatgggcgaatcattgtccaaatccaaaaagatgggcaaggaacgcgtctttcggtagaagattctggaatcggtattccggcagaagatctaaggcgagtctttgataagggatttactggtgagaatggtcggaagactgatatgcactcgacagggttagggctctatttagccaagaatctggccaaagaattaggaattgagttaacgatttcatcggttgtgggagaagggacaaccgtcacgctttacttccctctgctaagctactatcaagaaaatcgctaatgattttttgagaaataccatttagttcttgtctctataccgttttcactgatacactgaaccttgtgtgtcaaattgaatgataaggatggataagatgagtatagtatttgctttaataccgatgattgcctggggcagtatcggattggtcagtggaaaattaggtggggatgcgaatcaacagacattaggaatgacaattggtgcattccttttttcactgattgttttctttgtcactatgccgacgattgatggctggatcgtagtgattggtttgctgtcaggactttgctggtcagttggtcaaaatggtcaatttcatggaatgaaatatctgggcgtttcggtggggcttccgttatctactggtatgcaattgatcttaaatacaattgctggagcccttttttttggcgaatggacgcaatcacgagactatttgttgggaatcaccgcattgattttattagtaactggtgcctatttgaccgcacgacaagacggggaacaaatgcctgagacagaaaacaagatgttggattttcctagaggctttcgttcgttgatttcctcaacaattggctatggtgcttacacaatcattattacttgggcgggaattgacccattggcaataatcttgcctcagagtataggcatgctgattggcgctagtttctttgctctaagaaaaaccaaagtcaatcgggcggtctggaagaatacattatcaggattgttgtggggaataggaaatgtttgtatgttgataacagttcaacagatcggactggccgtgggtttctcgctgtcacagatggggattattatctctacactgggaggcatattcttattaggggagaaaaaaaccaaaaaagagttcaaatatgtggtttttggttgcttgcttgttatttttggtggtatccttctagggtatatgaaagctgcataagtagtgaaatttaggaggatttatggatttatttcgtaaaaaaactattgaagccagtcccgttagtcatttgaaaaaagatttgaaattgaaagacttgatcatgttgggtattggcgcaatcatcggcacaggtatttttgttgtgaccggcgcggcttctgctgtatatgcagggccagcattgatcttgtcatttgtcttagcggcttttgtcgttatcttatcagggctctcatttgcggagtttgcttcccgtatccctgtattaggcggtgcctattcgtatgtgtatgttgtatttggcgaatttgttgcatggctcgctggctggtttctgctatgcgagtttatgttggcagtatcttcggtggcctctggctggtccggttatgtccaagggttcttgacaagtatcggtgtgcatctgccaaaagcgctgactgctggctataatcctggcgaaggaacgtacattgatctgattgcaggattagtgatcatttttgtgacgatttgggtaagtcaagaagccaaaaaagccttgcgattgaacaatgctatggtttgggtcaaattcgggatcattgcgctttttatcttttttggggtattttttgtgaagccaagcaactggcagccgttcatgcctttcggattttcgggcgtctttaatggggcggcacttgttttctttgcttttttgggctttgatgcggtcgcaatggctgcggaagaagttgaaaatccgcaaaaagatgtgccccggggaattatcggttcaattgcgatcgctaccttattgtatatcgtggtcacgctgattttgactggaatcgttccctttaaagaattgaatgtcaatgatccggtagcttttgccatgcgatatatcgatcacggcttagttggttcggtgatttcggtgggtgccattttaacgctgctgacagtgacgatttccatgatgtactcattagcacgtttgctttatgctatcagtaaggatggcttgttgccaaaatcattgcaaaaaattaatcctaagcataagacaccgaaaaaagcgacttatgcagctggagtcgtcgccttcttttttgccgcagcttttccattgaatattttggcagaattaacgaatatcgtggcattggcctacttgatcttaatgtcgttggggatcatcaagctgcgtaaaatgatgggcatgcccaaaaaaggggaattcaaggtgccgcttgtgccagtcttgccattagtttctgttgctagctgtttgttcttgatgacgcgattgcagacagccacttggatcgtttttggtattacgatcgtcattggtttgctgatctattttatctatgggtaccgcaatagtgcattgaatgaagaaaaccagcaagagctttagtgtttgctaacgctcttgtttttgttcatgtcttggcaggaaaccaaaagtgatgacactgtaaaaaacgagcccctgagagattcccagaggctcgttcagctaatagaaaacagtattgcgtctgcctgaattatttgtttccagtcaagtccaacaagcgatctttgaggtcttcttccaagtgacccaattccacttcggccgctcggcgtttttcttttccttctttttggatacgcaatgtttcctgaattgtttcgacaagatcgttttgcgttttttgcagcgtttcgatatcaacgattcctcgttcgttttctttagctgtttcgatcgcagagaccttcagcatttcagagttcttacgtaagagatcattcgttgtttccgaaacttggcgttgtgcagtaaccgcatctttttgacgcaataaagtcagtgcgataacgacttggtttttccataaaggaatcgctgtattgacagatgcctgaatcttttctgctaatgcttggttggtattttgaatcaaacggatctgtggtgcttgttggatcgtgatctgacgggccaagcgcaagtcatgggtccgcttatctaagcgatccaaaaattgcgtatagtcattggcgatctgtacatccatctgatcattcgtttcttgtgcttttttcattgcttcaggaataatcgttgtttgtagttcttgcatttttaactcaccggcagcaatatagatattcaatgcatcgaagtaatctttgtttttttggtaaagctgttccaacatcaaattgtcttttaacagaccgtctttttctttgtctaatttaacagcgattttatcgatttgagcaccgattttttggtatttagcggtgatctcaaaaatcgattgtttgactttgccaaacatccgtttgaagagattgccttctcctgcacgtaattcatctggattagcttcttgcagacgatacatcaactctgtcaatgaatcaccgacaggtccgatatctgctgcttgcacatgattcagcatcgattgagagaattctcccagcttggtttgagcagctgcgccataggtaatgactgcttgttggtcggttggatcaatcttattcgctaactcttgtgcctgtgcttgtcgctcaggtggtaatttatcaattaagcgagaggctttttgttgttcttgcaaggcattgatctctgcctgctgggttgtcgtcaatgtatcgacaggggttgcaaatggattattcaatagatcatcaagagtatcgtttactggtttaacttgatttggtgtctccgtcattctaactcctcctaagtcttgtttcgaaaaaaatctagcctgggctagatttttttttggatcgcttcattcgaagatcgagcaaaggaatccatccctattcattatctcgttttatgctttgtttggcaatggataactcgatatcaagatcatctaaatcatctgccacaaactgctgataatctttagcgatcaacgaggccatttgttcaatgatttgagtgctttcttcgattttttcataggtttcacggcttttgatctcatgttcattgatctcaatgaatttgtctgtcaaatcaaccatgttcggcaaatgggtgtaaagaaaatgactcgccgaatgtaatttcgtcggttctttgaccaactctttgaacagtgctttcgaagcgcgtaatgcatcatgacgcaagtcgatcgcttttaatttattgctgcggttgatgtttttttgtaaatgctcgatctgttgtttggtttgattcatggtttctcggaacagttcgatttcacttggagacataccgcttttcaagtaatgcgcttctttttctttcgtcagtataggtaacacattgggatttgcttctaccttacgccccttcagaccaataaataccagaatcgcgccaacgatcagcaacaagacagtaaacaaatcagtgcctgtggaactgataaaggcaaaaagtgtgattacagcgatcgcagaaacgatcagccaaatattttttttcatttttcctcctcctaaaattctttggacaagtaatatagggattgttcgacatccttattttagcatgttcactagtagaaaaatatcagacttggggtggattttccgatatttagtaaaatcataatctttcttgctctttcttaaggagatatttttgagaaactatgctaaagtattttgtagaaaagacgttaaaggtcaggtgaaaaaatgttaacctataaagattttgaagaaaaaacgattgtcagaaacgagatttttcatggaaaaatcattgatgtcgttgttgatgatgtcgcattaccaaatggcggtactagcaaacgagagttggtctttcatccaggcggtgttgcagtgatcgctgtgacagaagaaaataaaatgatttttgtccgccagtttcgcaagccattagagaaagtcattttagagattccggcaggcaagatcgatccaggagaaggtgcacagcccgaattgactggtgctcgtgaattagaagaggaaaccggctaccgagcatcaacgttggaacatgtgcattcgatgtatctttccccgggctttgctaatgaagtgctgcatttgtttcacgcgaaacaattacaaaaagtagagaacccgctgcctcaagatgaggatgaagtattggaagtgtatgaattgacaatgaaagaagccaaagcagcaatcgcagatggaacgatctgtgatgcaaaaacgatttttgcgattcagttttgggagcttttagaattgaaacggaggaacagtcgtgcctaaagaaccactgatcacccgctctgaattgcgtcgacgtcgtgaagaagaaatggctgcttctgagcgaaaccaaaagatcgttgctaagcaagcaaacaaagagtggaagcaaaaagaaaagcaaatcgacaatcattatcggaaagtccgtaaaaaaaataaagcgatcactaaaacgagagcaggagaaaatcagaagtcccgcaacatgaatacttttttgatcaaagcaatcgtggtagtggcattgctgctgatcgtagttgcattagcgatctttttgctttaaggaacacgattaatcgggtttaattcgttgatcagcacatgtatctaatcaaaaaccagcacgcagagcatcagcgctcagcatgctgttttttttgttttatggctgggatggcttagcagcgctatatagaaaaagagcagcatcttgccccataaacaactgtggaccttcaaaaaatgtttcataacttactgaatcaaaacctactgattctgctagttggagcagcgtgtcttgctcaaatccattgtgtactttaggatgtgagacggattggtttttattgaaatcaacgatgaacaaacgtccgccgggttttaacaattgataaagttgctgcagtaaatgttctgtgtcgggaatatgaagcattaccagcgacaacagaacgatatctgcttcttcatgaatggactccttcgttaaatcgtggagtgatccagaaacatttgtcagcccttgctgggtgaccttctgatcaacgatcgccagcatgccctccgcagtatcccaaatctgcagttgcttgactaaaggggccagcggtaaactaacaagacctgttccgccgccataatcaataagaatttgttcacgggcattcatcagttggggtcttactgctgctgtaatcttttcagctagagcaatccttgggggtgtatcgtaatggtcggccattttattaaatatctcagacataaaaacctccttaatggtctgacaaaaaactgttcctttgagtaaaactagtttatcataaaaggagaaaaaatgatcttttattaagatataatgtataggatcgtcaggaggctacaagatgaaaattggtattatcggtgcaatggatgaagaaatcaagatcttgcgggaagcattggaagctcccttatcttgggagcgagctggagcactatttatttccggcagtatcggcaatcatgaagtgatcgttgttcgatctggaatcgggaaagttgccgcttcactgacaacaagtttgctgattcagcaatatggggtcaacatggtgatcaatactggatctgctgggggaatcggtgctggtttagccgtcggcgaccttgtgatttcagaaaaactagcttatttcgatgtagatgttactggatttgggtatacatatgggcaactcccagggggaatgcctttgtatttcgaggccagtcgttacttgatcggcgaaatgaccaaagccgcagaagcaacgaatcacaatgtaaaaaatggcttgatcgtaacaggggacagctttatcaatgacggacgtaaagtacaagaaatcctaaggcacttcccagacgctttggcttgcgagatggaaggtgctgcgatcgcccaaacagcgaagcaattcaatattcctttccttgtcgtaagagccatcagtgacactgcggatcatgctgcaacagtttcctttgacgaattcattttggaagccggcaagcgctctgcagaaatggtgctcgcctttgttaaaaagctgaaataaaattggaggagatcacaaatgaacgcattactctcaattgattatacggtcgattttgtagctgatactggtcgtttgacgaccggtcaagcgggtcaagcgattgaaacaacattagtagatcatacccaacgatttatcgatcaaggggattttgttgtctttgccattgatcgccatgaagcagaagatccttatcatccagaaaatcagttgtttcctcctcataatctggcagggtcagagggacggaatctctacgggacactagctgcagtgtatgaagatcacaaagaaaaagaaaatgtttactggatcgataagcgccactactcggcgtttagtggaacagatcttgacattcgtttacgggaacggggcattactgcactttatttgactggtgtctgtacagatatctgtatcttgcatacggctgtcgatgcgtataaccttgggtatcgattatttattttcaaagatgctgtcgcaagtttcgatccagtcggtcatgaatgggcgttgcgccactttgagcagacattaggggctactattctttaaaaaaaggagctgagtgtaatgggatttatggatcaattaaaagaacagtttagtttcagtgaattgacaggattgtatcagtcctataaaagcggtgaattggatgttgacaagattttgaatgatacgttcatgcaaaagtataccgattttgaaaatgtggaagcattgatgacaaaactaggcattcaagataaagatcaactcatggactttatgaaagatagaagcaaccggtatcatgctgaccaagtcgtaaaggaccattcccaatttgattctctaatcgaaatgatcaaaaaagcactaggaaaataaaatcaccgcccccgaaaagttagctgtttgctgctaacttttcgggggcggtcttaatattgtatcttttgatgaaggtgacggctgattgtatttctgaactactttggctaatgatgtgaggtgaatcctctttttttagaaaagttgcatcaacaaatggaccaatgattcataaccaaacagttcgtaacaaatgcctcgtagcaagctgtatcttaccagatttgaacacggtcttcaggagcccggtacatgccatctcccggttcaataccgaaagtagtgaagaaggaatcgatgttttgaacttggatgttggcccgtaacttggcagggccatgaacatcaatggccagcagcaactgttgatattgttctttggcttttgtgcgccaaatttttgcccaattgataaagaagtcttctagtgagacgtcagtttctttttctgctgcttctagtgcacagcttaatccaccagcatcggcaatattttccgatactgtcaaggtgccattgaccgttccaccagcaaatggcaagccgtcgaattcattgatcatttcttgagccaatgtctcaaaatgggccaggtcctctgctgtccaccaattattcaggttgccgaattcgtcaaatttggctccgttattatcaaacgcatgggaaatctcatgagcgatcactgcaccgatcccaccataattggcacttgctgattgagaaagactgtaaaatggtgcttgtaaaatagctgctgggaagacgatcacattcttgaaaggatgatagtaggcattgactgttgctgcagacatttcccactcctcgcgatcgaccggtttttgccatttgctaaaaagatcttcccggaagatacgtccaaaacgtagtgcattttgtaacaatgatgcatcagggtctgtgtgcagtcgatcatagatggctgggattttgtctggataaccgacatggattcctagtttatttaatttaacgattgctttttgtttggtatgctcgctgagccaagtattgctggtcaaacgatcttgatagacgccgatcatcgtttccaccatatgttttacatcattttttgctttttcaccaaaatacttgcgaccataataatcaccgacgacttgactaaattggccaattgtcagataataggcggctttttctttaggcatcgcttcatcaacgccagagaggtaccgattgtaggctccgccgagttggcgtagttcttcactaagatatccagtgtagcgcaaactttgatgaacgatcatccagcttttcaataaatcaaagtgggtaggagagacaatgatatcgaatgcctcaaagtactcaggctcagtcacgatcagctcttttggttcggcatttaataaagcggttaatgtctttttgaagtcgagttgcgccgaatgctgtgcaaaggtatctagactttgcggattgtaatttttgctgtaatcggcattttcttctgcactgcgaacatgaggagcaatcaatttatcaaaagccagtgtttgttctaccagcgactctgcttcggattgtgatttccctaatttcgttaagagcgcaacagcattgtcgaagaaaacttgtagtaactcttctgcctgcgggtggtcagtataatatgttttgtcaggcaagatcgttgctggcggataggccaacagtgtattcattttcgcgtttttcatatcggagtcgatatcgaaagcaaatggtagttggatgccgttaagaatgaattcaggtagctgtgcatttaactcgtcataagacgcaagggtttcgatttttgccaaaatcggcaaaacttcttgacctgcgttttcatcacgggtagcaaaatcgcttgctaagcgatagaaagcaacggcgtctttcatttttcctttaggaattgctaaaggatctgccgccatattcttgaactcagccatcatcaactgatcgattccgtctaccagatcttgaaaacctccagttgccggtttatccgcagggatcaccgctgattccaaccaatcgccattcacataatcataaaaatcatcttttaataatgttgtcatatgcttcgctcctttttatgctttctcctattatggaacaaaattttccagtacgcaaaaaaagtttgtttttttcttaacgaaaaagttccttagtgtctaaaccggctgattcccgtggtactattaagatatactttggtaaggaggaatggcgatggaagaaagagagaacatagatacttggcagggaataccagaagaacgattccgccgctacaaatcttgggtaacaccttccggctatttgtgcggaacttatgctgccaccgtgtttttggcttattatcaagattatatcgatgagcagatcatccctaaaacagtgagaaggaaaaatcagctgcagccgggcgcactgactgacatcttgcggctcttgattcaacctcatggattgccaacgattgcttggcaggtggctcatggactatcacgctttttcactcattttgatctaccttatcgggggcgtgccacagttttcggcggctggcagcgagcctgcaaacggatcgatcaaggcaaaccggtgatcgttggtctcttgaagcctttaggaagtacctacggcaatcactgggtagtcgcatatgcttatttagaaacagagaccggacgttatctaaaagttcatgacaactgggggaattacaatcaagtgattccagccagctggattaacggaactgtctcgttaccttaaattaatttaatgaaaaaagcacctataatgtgctagaataaaagaaacaattcacttcacttggaggcagacatgggcgaaagttataaagatagttcattgaagattttcagtttgaacggcaacagaccgttagccgagaaaattgcaaaagttttcggtacagagttaggtaagtcaaaagtaacacaatttagtgatggagagatcgcgatcaatattgaggaaagtgttcgtggcgatcatatttttatcattcaatcaaccaatgaaccagtcaatgatcactatcttgaattgttgatcatgatcgatgccatgaaacgtgcaagtgccaaaacgattaatgtggttttaccgtactatgcgtatgcaagacaagaccggacggcaaatcctcatgaaccgatcacggcaaaattgattgccaatatgttagtggaagctggggcgacacggatcttgacattggatctgcatgccgtgcaggtgcaaggcttctttgatattcctgttgataatctatttacgattccgcttttcgcgcattattatcgcgagaaaaaaatgatcggagacgaatatgtcgttgtctctcccaaaaatagcggagttcagcggacccgcagtttagccgaatatttagatacagcgattgcgatcgttgatcaagatgaggcagatggtggctatgtgattggagatgttgccggcaaaaaatgtattttagtagatgatattttgaatacaggcaaaacattgtcaaaggcagcagatttgctaaaagaagcaggagctagtgagatttatgcgtgcgtctctcatgcgttattgtcaccaccagccaaagatattcttgatcaatctgtcatcgaaaacatttgtgtcacagattcttgttggactgccgaagaacggcatccagaacggttgtcttacctttcttgtgcagaactgatgggcgaggctgtcaaacgaatccacgaaaatacaccgatgagtcccctgtttcggttagaaagcaaagaatacaaataagaagcaagagagttcggttattctggactttcttgcttcttatttgtcatgagacagtgcaatttatgctaagttattgaggttcaagacagtctctcgtttaatcagcttatgcgggacgacaagctgaaccgcatttgaaccttcatggtttaattgtgccatcaagctttctgtggcgatttttcctaaggataagacgttgatgtcaatgctggtcaagtaaggatgggtcaatgtagcaaaaatcgagttattaaagctgatcacagatagatcatccggaactttatacccgaacatcgttgccagttggatgatccgaactgcaaaaagatcatcgattactacgattgccgttgcttcggtctctttgatcgttgtctcgaaattgacatagtcttctgcctgttcaaatgtcaatgccggataaaaaggcaggttggctagcatcattgctttttgatagccaaagaaacgttcgaaatagagattttcgtgagttgtattcgtagcaaacaatatcttagagtgtccttgggagatcagatactctgtcgcttgttttcccagcatttggttgtcattatcaacaaaaacgatattttgttcattgctgtaaggatgtccaatcaatgtgaaaggaacttttttacgaactaaataatcaatgattggatctttttcatcggaatagactaagataaaaccatccacttgtttttgaaggtgcatacgttccacatttttcaataatgtatcaaaatcacgggcagaggcaaccgcaaccgtcatttggtggtggcgagcttcttcgttgatggcttcgatcgtttctaaatagaaaggatttcctagccgttcctttgaatccaaaggcggcaagataacaccgatcgcgcttgaaatctgcttgcctagatttcgcgcagccaaatttggcacgtagcccatctcagccatgattttgcgtactttcttttttgtgtcttcagagatactagggtgatcattcacgacccgagaaacagttgaagtagcaacgccggcttttttggcgacatctttgacagttacgctcactgttttccctccttttttagcttatagtatcataaagttgtgttattttggtagccggaaagaaaagaaagaagaaatgccttcatttcttctttcttggtttctgatcaataattaagcaatagttactgagacttcttcttccagcagatgctcttttccataaagctgaactgtcaatggctcaccactgattttctttagtgtgacagtttcttctttaacagaaatgaataataagcgtccgcgataattgatatggaaagcatagctgttccaagtcttcggtagaaacggggcaaaacctagatgggcatggtccgtcttcatttgggcaaatccttgaacgatcgctaaccagctgccagtcattgaagtgatatgcaaaccatcgtcggtatcattgttgtagttatccaaatctagccgagccgttcgttcatacatttccagtgctttttcttccattcccagctcggctgctaagatggcatggatactaggagacagggaagactcgtgcactgtcattggttcatagaagtcaaagttgtttcgtttttcctcttctgtaaattgatccccaaagaaatagattccttgtaagacatccgcttgtttgataaagcaagagcgcaagattcggtcccatgaccaattttgattcaatggcaagttttctggatctaaatcagtgactggcatcaaatctttgtctaagaaggtatcgtgctgaacgaaaattcctaagtcttgatcttctgggaaatacatattgtcaatgatatcctgccagtagtcttgctctttttctaggatcgttacggttgcttctgtggcatattctttataactttgtaaagtatagctcaagacccaggtagccatcttgttcgtataccagttattgttgatgttattctcatattcgttggggccggtaacgccatggatcatatatttttgctgacgtttggaataatggacacgatctgcccagaaacgagcgatggccgttaatacttccaagccttcttttttcagatagctcgtatcacctgtgtaattcgtgtagttatagatggcataagcgattgcaccatttcgatggatctcttcaaaggtgatttcccattcattgtggcattcgatccctgtaaatgtcaccataggataaagcgcgccagccaagccttgtttttgcgcattgatatgggcttgcggcaattgattgtggcgatatttcaacagattccgagtgatttctggtttcgctaatgccaaataaagaggcacagcataggcttctgtatcccaataagtagcgccaccgtatttttcaccggtaaatcctttaggtccaatatttaaacgttcatcttctccataataagtcgagaagagttggaataaattgaaacgaattccttgttgcgcagcagcatcgccttcaatgatcacatcagctagtgcccagcggtctttccaagcattgacttgttcttgccgtaagtcttcgtaaggtgcgctgtacacttggaaaagctctgcaatttttgttacttgatcatgaggattgacatcacgactggtaacgataatcacgtctttttgtaaatgaaagacagctcctgtttctcctgtaaaagtaaacgcgtcagcaatcgtcaattcactcgtctctgtggatgctggctcttgactatgacgcattgcggcagtgaccgtgaattgctcaatgtcaaagttgttttcaatggtacgggtggtcagataacgatagttgcctgagctgccgtggtctaattcttcccagaagcgttcttcgtaattactatcttcattgcggacattattgtctagtttagaaatgactgtgatttctgctgatccttcaaggatttctgcctgcatcgtgattaccgccatttctcgcttgacgatacttaaaaagcgctcaaaagtaaatttgacagttgcgccagctaatgaaaccgtaaatgtccggcgtaaaattcctgtttgcatatccagttccatataaaaatcgctcggactgattttcgcaagatcaacagcctgattgttgatgaaaagatccattgcaatgaagttaacagcattgatcacttttccaaaataatccggatagccatttttccaccagccaacacgagttttgtctggataccagacccctgccagataagtccctagatggtgatcgccactatattgttcttcaaaattaccccgcatccccatgtagccatttccaatacttgtaagcgactcttgtagtcggcgattttctttatctaaagtagttgttgcgattttccaaggatcgatatcgaacaaacgctggatttttttcataggtttttcctccaaaatctttttgataactctataataaatgcaaacgattgcgttagtcaagcgtaaatcattggtttctatgcttttttaaatagaagtgtgacaaagagctgtttttgcgcatttttataaattaatgactgaggagaatgtaaattgaaatttctcggtttacaaaattttcaatctccgctacaatgtggttattaagaaaccgattgcgtaaaacggtggaggaggaagaaagaggatgaaaaaattactaagctttgaattctggcagaaattcggaaaagcactaatggttgtggtagctgttatgcctgccgccggattgatgatcagtattgggaagacgatccccatgattaatgccgattgggcatttttggtaacgaccggtggtgtgatcgaaaatattggttgggcaattattgggaatctgcacttattatttgcattagctatcggtggtagttgggcgaaagaacgcgcaggcggggcattcgctgcggggattgcatttgtattgatcaatcgaatcacaggttcgatcttcggggtcacaagcgccatgctgacggaagaaggggcttttactcatacattgttcggtacgaaaattatggtggatggcttttttacaagtgtcttagaagctccggcactgaacatgggtgtttttgtagggatcatcgccgggtttgtgggtgcgactgcttataataaatactataatttccgcaaactgcccgatgcgctttcgttttttaatggcaagcgcttcgtcccgtttgttgtaattgctcgttccgtggttgttgcgatcgtgttagcgatcgtttggccttacattcaagcaggaatcaataactttggcttgtggatcgcacaatcgcaagaaagtgcgccgattttagcacctttcttgtttggaacattagaacgattactattgccatttgggctgcatcacatgctgactattcccatcaattatactgaattgggaggcacctatacgatcttatctggtgcacaagcggggacacaagttttcggtcaagatcctctatggttagcttgggcaactgatttagtcaatatgcgaaatgcaggggatacttcacaataccaattcttgatagagaattttgtgcctgcacgtttcaaagtcggacaaatgatcggttcttctggtattttgatgggacttgcctatgcaatgtatcgcaatgtcgatgcagacaaacgccataaatatacctcgatgtatttatccgctgccattgcggttttcttgacaggtgtgacagagccattggaatttatgttcatgtttgcggctgtaccgttatatgttgtttatgcagtcgttcaaggggcagcatttgctatggcggatatcgttcacctgcgtgttcactcctttggaaatatcgaactattgactcggacaccaatggcgatcaatgcaggtctgggtcaggacttgatcaattttgtcctagtaacgatcgcatttggggtcggcatgtatttcttggctaacttcttaatcaaaaaattcaactttgcgacgcccggacgcaacggcaactacgaagtagaaggagctgacgaaaacgtagcaacaactgcctctgacggaacgttagatccaaactctcaagtggttaagatcattcatctgttgggaggacgtgaaaacatccgcgatgtagatgcatgtatgactcgcttaagggtctctgtcaaagaccctagctcagtaggagacgaaaagtcttggaaaggtgctggcgcattaggtttgatcgtaaaagataacggagtgcaagcggtatatgggcctaaagccgatgtacttaaatcagacatccaggatatcttggattccggtgtggcgattcctgaagcagtcataaaagaagtcactaatgagacgaatcacgaaagccaagggataaccgctgaggttgtttcagtagccgatgggcaagtgattccgatcacggaggtcagtgatcaagtctttgcagagaaaatgatgggggacggatttggcgtgattcccgataacacgcaggtgtattcacctgtctctgggaaagtgacgaatgtttttcctacgaaacatgcgattgggttgctatctgatgaaggagtcgaagtattggttcatatgggcttggatactgttgaacttcaaggggcaccattcacagtttctgtcacagaagggcagcaagtcacaaaaggtgacccgttggctttaatggatctcgcagctatcaaagaagcgggtaaggatacaacgatcgttgtagtaatgacaaataccgatcaaatcgattcctttgaattgtcccaaactggtcagcaaaaagctgcagcagttgttggaatcgtcaaactataataaaatgactaagagctgtgccataagtattttaccaaactgaatatccaaacgatcgtggggttgctacagtctggtagtttctcgtcgcaattcacgagaagtacagctgatctcatacagtgcggatagtttcgtctggttcatacttatggcacagctccgttcttttatttacattttgaaagaagataatcaaacgcagaggagcgttattcatgaaagttttaacattaaacacccatagctggttagaagacgatcaagaagcaaaattaaaagtgatcgcacaagaaatcgcagcaggagattatgatttgattgcgttgcaagaagtcaatcaatcgattgctgctacaacgatcgttccggatggtctttattgtccgacagaggcgatccttgagatcaaagaagacaattttgctttgcgcttagtagaagaactgcagattctggatcacgattattattggtcatggacttacagtcatgtgggttatgatgtctatcatgaagggaatgccttactgtccaaaaatccaatcattgccaaagaatatttggcttctgagacaaccgatgtctgggaccatactacgcgaaaaaatcttagcggtctcacagaagtagacggcaaaatgatccaagtgttaagctgccatttttcttggtggaatgacggcaagtttgcctatgaatggcagcaaaccgaagcgtttttgactgagcgagcagcatcgctcttgcttttaggtgatttcaataatgaggcagacagcttgggttatcagctggttaaaaacagttcattgcagctgcaggatagttttcttgccgcaacaaaaacgatcggtgaggcttcggttgttaaagcaatcgatggctggcaagacaatcagacagccttgcgtatcgattatgtctttgcctcacagaatgaacagcccgtagagtatgaagtggtctttgacggtcagcggctgccgatagtcagcgatcattttggtatctgtgtggtttttgaataaccaagaatagagacgacttcgattattcgcttgctatcacttgaatcggctagagattcaggaagcagacaatcgattaaaaaaaggatgagaccagaaacgaatttctgatttcatcctttttattttgatcaaatgtcaatcgaaccatagcggttttttaaggcagtgcgtattaagcgttctgccaaatgttcattccgggcaagcagtggaccatggaaataggaaccaaaaacattgcggtagaccacgccttctgtttggtcctcgccattgtttccctgcccttctacgactttacctagtggtttctcacctttgccaagaaacgtccgaccattgtgattttcaaaaccataataggtctcatcgaattcttcattatggataacgatatctccgatgaagcgattgttttcttgactcaatgtgtaatgatccaatgcgctaattcctttgattttctctccgttagctcccatgtagtaatgacctaacaactgatacccgccacaaatggccaacatgactccatcgttctcgatgtattccgtcaatgcttctttttttgtttggatatcttcagaaacgatcagctgttcaaaatcctgtccgccgccaaaaaagactaagtcatacttcttcggatcaaatggttcatggatgctgacgacttccgaaatgaattctacacccattttttcggctacataacgcaacatcaacaaattgccattatccccgtaggtgttcagcaaattcccgtaaagatgagcaacattcaaacgataattagccacgatccatcccccctttgatatagcctttttctgccaattttttgcgtagttgcaaaacagcagtataggttgctaggatatagactttttcagttggtagattggcgatatctttaatgacctcatcaagatcttttgtttcggtgatcttttcttcgggaattcccgctacttttaaacgcagcgtcatatcttgatggcggtcgccgccagcaatgacttgaggaatcgccatttcggcaaatgcttcatgatttccatcccagatccagctaacatcaatgccgtccgcataatttgcattcaagagactgacgagagaaaaaggatacggagataagccgatcatatcgatcacttgattcagtcctaccggatttttgactaacacgagtgtacactctttgccatcgatggtaatgacttcttgacggccaaagactttttcatcataggccaatccagctctgattttttcaggtgcgacttgataatattccgctacagcggtcgctgccaatgcattatagacattgtacatgccgccaacttcgattccatatgaattcccatcaatgataaaatcagcagaagtattgtccattgctgtgatggctgtcaatttgtagtctagttttggacgtttgaagccgcagttcggacaatagtatttgcctagattcgcataggtaatcatttggtaatgtaagatgtggtggcattctggacaaagaaccccgtctgtattgtaatgggccatctgctcctgattaggtaagtgatcaaagccataatactttcttggattaacagtagtgacagaattgaacaacggggaatcaccattacatagaattgtggccgtcggtgaatttgctgctccttcaacgatcattttatatgttgtatagatttcaccataacggtccatctgatcgcgaaaaatattcgtgaagacaaatagttcaggtttgatatacttcgttactttgctaagactagcttcatcgatctctagtactgcaaactttttgccgccttttggtttggcagataagaaagtagaaacgattccttggaccatattggcacctgttggatttgtcagcacatcatcaaattcttgccgtaaaatattcaccgtcagtgcagtagtcaaggtttttccgttcgtaccagtgataacgacaacttggtaatcttttgctagatgatctaaaatatgcggatcgatttttaatgctattttcccaggcagacttgatccgcctttaaaaaagttttttaatacccactgagaggtcttaccgactgtgacagccagttgacttcttaaccccatagttgaacctccaaacgagatgattgtctttttagtttaaattcaatttatcataccatatgttctaaaaaaggttaaacggcttttcgatttctttaagtttctgcaaagagttcagtttattgaaccaaaaaaggcagagacattcgttacaaacaagatgtctctgccgcttcaaaacgcttgtggaaggctcgcgactttaagatacaacgcttagaaccttcaatagcgccattttactggctgtttaaccaataataatcttctcggttgggtattcataacctaaatctcgggtttcttttggcacaaacaacaacaacgtataaagcatacctacacgtccaatgaacatcagtaaggctatcactaacttacccacacttgagagatcatcggtgatccctaacgataaaccggtggtcccaaacgcagaagctacttcgacaatgatggcgatcaacgggatatcttcagtggcagtcaaaaataatacgcagaaaaagcacattcctaaggataacatgaagacaacaaccgacttacgcacatcgtcttcatcgatccgtcggccaaatatgttgatattgtcttcactctttaagaaggcataaagataaagaccaataatggcgatcgttgtcgtacgaatcccgccaccaactgaacttgggctgcaaccgataaacattagtaacgaaaaaacgatcaatgtcgtagtctgaaagttccctaaatcatggatctgcagtccagcattacgggtagtcatggaataaaacatactgttgatccaggtgctgctaaagccgtaatctttgaacagatggtctttctctaggaaataaatggcgatcgttccaccgataaacaaaatcacaaaagccaacatcgcgatttttgtaaacaatgaaaagcgaaaaggcagttgtcggcgattttttttcagcttgaagagggcccattctcggaaatccataatcactggaaacccaatcccaccggtaaaaatcaaaaacatgatacaaatcaaaaagaaataatcatgtgcgaaaggtaaaatggaatttcctgtcacgtcaaaaccagagtttgtgaccgcggaaatagcttggtaaaaaccataaaatagggcatcccgccaattgtcataatagccattaaagtaaaaataaatagaaaaaatagcgccagagatggcttggcaaagtaagatgatcgtaaacgtgattcgaatcatccgcacgattccgcttagctttggctgattcatatccgtcataatcaactgacgctgcttcaatgagatctttctccgagaaacgatcgcaaagaaagtggagatcatcataatccctagtccacccacttgaaaaagaacttcaagaagcactacaccgcgatcattgaacacatcatcgatagggaatgtcgtcaatccggtgacactgaccgtgctgactgccataaaaaacatatcgatgaaggaagcatgagaacgaggttcacgaaaaaagggaagataaaataaacctaaggaaataatcgtcatcagaatatagtaaaaaacgatcacttggatcgaagaaacattttgggcaataaaatatttgcttttgcgttgtgtcagacgagcaaaccgcgtgaaattcataactagtctcctcactaaataaactacccacagtataccaaagaaccaagcagtttcaaaagaaagcaagattgaaagtaagtagcagccaatatcatcaaagaaacgctctgcaaaaatatgagatagtgccgcaaaacaattaatggaacagagaagacgatagcctgtcattgagagagtactagaagatagcggtgagccggacaaaaaactgtatgcccgataagtctgttgggcatacagtttttttgaagagatcggttagttagagtgcttccaccgcttcgattgcgcgaaagactttttctggagtgatcattgggtcgatcaggacaaatgtttcttcttctttaacggcataagtcaaaacaggcgcaaaataagcgcgatccacacgagtgacatgcaagtcttttagtttcataggtaagtgcaatgcttcgtagaaaggacgcagttcctcgataacagcaaaatcgttggtgtaggcaagctgtacccagatgcagtaggccactttattgccatggaggacactgtgggtttcgctcagataagataagccgtcatgtaatgcgtgggcgccagaagttctgccaaactctacagcaaatccaccaacttctcctgctaaagcgatgatggcatctgtgattcgcgcaaaagctggcgtcaagcgcccggcttctaaatcagtgactgcttggatggcatctgcgatcaagagttctttgattagttttgcactttgaaaaccgagccgaaccaaggctgttttatcttcttctgccatcgtgcgtacaatggcttccatttcataatacttggctagcgtgtctgcgatgcctgcaatgaaataatccacgggtgttgctagcaagaatcgagtatcgacgatcgtcatataagccccttttttggcgtaatcgatcttgcagattgtgtggtctgggtaataggcgacaatcacaggagtaaagggtgcacagttggaaaccaatgtagggatgacgatcagctccgcttccattctttctgcagtaatttttgcggtatctgcgacacgtccaccaccgatcgcaagcaggacatctgcgtgtttgatcttatccgctaactcctgagcattctcataacttgaggagccatcatagcgataaacaggatagtcaaatggatgcggataataggttttaaaaacgtcaaatgattgatcgccagtaatgacagcaacctgatcaaaatcattgagatactctggtagatcaaaaagaactccttcaccagtaatataccggtttggtccagggcggacttcattggctaacataacacaacactcctttgcaatcgtcagaattttctaattagtgtaacgtggaatagcgcctgctgtcaatttttcttttgagcagttttgttcagatcagccaggccaaagccaatcggcgcaagcaggcgtaaagagggcataaaaaaagaccctaacaaaggagagtttgttcttgctagtcttcgcataatcaagactgttttgcgaagatcctctccttttgagggtcagttgttgggcgagaaaacagcactatttctatctcagaaactaaaggaatattcaaactgccgcttctcaaaataggttatgtccagttttgacggatgaaaccagctcgtcctgaaccttcacggtaggcgttgtaatgcgccgtatttttcttataaaaatcttgatgatagtcttctgctggatagaaaggttcagcaggttcgattgttgtcacgattggatctgtaaagcgaccgcttgcttgcaaagcggcttttgaagcttctgcgatttttcgttgttcttcactattgtaatagatgactggacggtaagagtccccacggtctgcgaactgaccaaaggcatctgtaggatcggtttgttgccaatagatagccacgagttcttcatacgttatttgttcaggatcgaaagtgatttctacggcttctgtatgtcctgtggttccagttgttacttcttgataggtaggatgagggacatgtccaccggtaaaacctgagactaccgaaagaattcctggtaaagaatcgaaaggtttgaccatacaccagaagcagccgccggcaaaaattgcagtatctttcattgtgattcctcctttggttttatggtatgcttcttatagagaaagacaagcgatatgcttataagaaacggccaaagaaagcgaggtttgctgtggatacgatcatcattttattgcgggggaattctggcagcggaaaaacgacagtagcaaaagcgctgcatcaacaattaggggcagaagcggtgttgatctcacaggatgtatttcgccgagaaatttttcacgtgaaagatacgcctaataatcatgctgtaggtctaatgatggaggcccttttatatgcgcgagggaaggttcctttcatcatcgttgagggaatttttgcccgtgaaaaataccaggacttcttgctctttttactagaatcctttgagaagtgtctcatttattattttgatgtgccttttcaaacaacgattgaaagacaccgaacacggccgcaacgggtatttttttccgaatcatcgctacaaaagtggtggctcgaaaaagaccttctctttggggaaaacggcatagcgtccaagagcaatgatacgagtaataaatcagtcctctcaaaagagaagatgtttacagagaagcagacaatatctgaaatgatcacgatgatcttggaggatacgaaacagtttcaaaaatagccttgaagcaaacgatctgttttccaaaaaaactaaagtgaggtatctctatgttagacaaatcaattccttatgcagaaatttggatggagcgcatggctgcggatgaagtagcaccggtccctgactcaaataactacatcattcaaccttatcaatccggtgatgcgagtgagtgggcgcggattgagacagcggtgggagaatttgatacagaagccgcggcacttgcgtattttgaaaaagactttctcccctatgaatctcaattgccgcaacgaatgttttttgcagtggatccagaaggaacaaaggtaggaacagcgactgcttggtggaagaagaagcaagatggcaacattgtgccgctcgttcattgggtagcagtcattcccagcgctcaaagacaagggatcgctcgcggcttggtaaccaaagttatagaaacatgccagaaccaaacggcagattccgaagaatctgctgccgctatttttctccatacgcaaacatggagtcatgctgcgattggactgtatcaacaactaggcttcaaacttattgatacagactatcagggacagatgaatcccgagtacgaacaagtattgactattttgagagacgtggcgcagaaggaaaacgggcagtaaagccaatcatttgcaggcatcgttctgttcagtacccctcttagcgacttctgaatttaaacctgtaaaaattccttgttttcaagtataataccaaaggagtatcaggaaggatgggcaagatggcacaacttttttttaaatatggcgcgatgaatagtggcaaaacgatcgagattttaaaagttgcacataattatgaagaacaagacaagccggtcgtgattatgaccagcggcatcgatacccgaagcgggatcggaacagtttccagtcgtattgggttagagcgtgacgccattccgattttcgatgagaccgatttgtatcatttagtaaaagatctaggatatcaaccctattgcattttgattgatgaggcacagtttttgaaaaaacaccatgtcttggcgtttactaaaatcgtagacgaattaggcattcctgtgatggcatttggtttaaaaaatgattttcgcaacgaattattcgaaggttctaaatatctgcttctttatgcagataaaattgaagaaatgaaaacgatctgctggttctgccacaaaaaggcgaccatgaatctgcattacattgacggtaaaccagtctatgaaggcgatcaagttcaaattggcggtaatgaagcctattaccctgtttgtcgcaaacactattttcaccctggaatcaaaaaagaaggagaataaaacatgtacgatcagttacaagcgattgaagaccgttatgaagaactaggcgaactgcttagtgatcccgctgtcatttcagatacgaaacggttcatgcagttgtccaaagaagaagcaaatacccgagagactgtcgaagtgtatcgccgttacaaagaagtcgttgaaggcatcaaagatacagaggaactattgggcgaaaacttggatgcagaaatggcagaaatggctaaagaagaactatctgacttaaaaaaagaaaaagatgttcttgaagaccgcatcaaaatcttattattaccaaaagatcccaatgatgacaaaaacattatcatggaaattcgcggggctgcgggtggagatgaagcggcactatttgctggagatctctttaatatgtatcagaaatatgcggaaacacaaggttggaaagtcgaagtgatggatgccaacgttaccggcatcggcggctacaaagaagtcatcatgatgatcagcggtgagaatgtctattcaaaattgaaatatgaaagtggcgcgcatcgggtacaacgcgtgccgtcgacagaatctcaaggacgaatccacacatctacagcaaccgtagtcgtgatgccagaagcagaagaagtagagatcgatattgctgataaagatatccgaacagatatctatcatgcttcaggcgctggtggtcagcacgtcaacaaaacggcatcagctgtccgcttgacacacttgccgactggtatcgtcgttgccatgcaggatgagcgttcacagttgaagaaccgtgagaaagcgatgaaagtcttgcgggcaagagtatacgaccaaatccagcaagaagcacgaagcgaatacgatgcaaatcgtaaatcagcagtgggaactggggatcgttctgaacggatccgtacgtataactttccgcaaaatcgggtgacggaccaccgcatcgggttgactatccaaaaattggatcaaattttggctggaaaacttgatgagatcattgatgcattgatcatgtacgatcaaacatcaaaattggaagaaatgcaaaatgggtaaaacctatcgagaagtcctttcacgggcttcttcttttttagaaacaaagggactggaagggtatgcgatccaatacctttttctggctcgtaaaaattggcaaaaactagattggttgctgcatatggatcagcaaatttcgccagctgataaagtgcaaattgaagcagatctgcagcagcttttagcgcatcgtcccccccaataccttttaggctatgaagagttttatggccatcgcttcaaagtaacagaagacacattgattcctcgaccggaaacggaagaattagtcgctttgtgtctggagcaaacagaacctgcagagaatttgcgggtcgtagatattgggacagggacaggtgcgatcgcggtctctttgaaattggcacgtcctcactggcagatcgctgctgttgatctttcagaggccgcattggcggtagctaaagagaatgcggcgcaattaggtgcggaggtcgctttttatcaaggcgacacgctgacaccagtgggggatcaatcatgggacatcattgtatcaaacccgccttatatcagtgagcaggagtgggagctgatggatgccagtgtgcgtcagtttgaaccccaaatggccctttttgcagcggagaatggtctagtgatgtatcgtaagattgcagaccaggcaaagaagttattgacacctgacggaaaaatcttcgtcgaaatcggttttcaacaaggcaaatctgtccagcgtatttttgcggaagcttttccagataaaaaagttacggtcattcaagatttatctggaaaagatcggttggtcgcagtacaataatccacagcatgtggacaaccatttttttgaaaaatttttttgataaaaaacagtgatagagtaagacttacttgcgaataaaagttataaacagggttatccacacttgacaaacgatttatccacaaaatgtggataaaaaccgaaaaaatgttgataagtgtggaagtcctcaaaaaaaggatgtggataaactgtggaaacaaaaaaatttagtgaagaacaattatccgaagcagcaaaaattttagccgcgggtggattagttgcttttcctacagaaacagtgtatggcttaggcgctaacgctcttttgcctgaagcggtagcacaagtctatgccgtcaaaggaagacctagtgacaacccattgatcgtccatctcgccgacccggaacaactgaaggattatgtggataacttgcatccagcagcggaaaaattgatggcaaagttttggcctggccccctaacattgattttttctatcaaaaataacagtttaccgtctattgtgaccggggggttatccacagcggcattccgtatgccagcgaataaaaaaacactttcagtcattaaacaggcacatgtcccactagtcggacctagcgcaaatacctctggcaagccaagtccgacctcagctgaacatgtattgcatgatttgaaaggaaagatagctggtgtgatcgatgatgggactactaggatcggagttgaatcaacagtcttggatttaagtgatccgacagcaaacccaatgatcttgcgtccaggagccgtgaccaaagaacaattagaaacggttttaggcagtgaagtcgaaatagataaacacctagtatctgaaggtgaaagacccaaagcaccgggaatgaaatacaaacattatgctccggatacaaaggttgtgatggttcggtcagaggactggccagcagcactcgattgggtcaagcagcagcgattgcgagcaggtgtcttggcaggcccatcaatttgtgagacagccagatttgaaacagcagctgtttacatgtatgcggacgacacggttgaggcagcagcaaaaggactttttgcaggtttgcgagccttagatgaatcgatcgctggcttggagatcattttagtgaccgcttttcctgagacagggatgggcagcgcctatatgaatcgcttgaaaaaagcagccaatcaaaatttttttcaggtaaaatagaaaaaacgctgctttgatcataggtagtgcttaggaaatatgatacaatgctagcattaaggtaaaggggtgttgtatgaatggactatcaaacgtttgatcctgatttatggcaagccattgaaaaggaagcggatcgccaacaaaacaatttagaattgatcgcatctgaaaatatcgtttccgcaggtgtaagagcggctcaaggcagtattttaacaaataaatatgccgaaggatatccaggtcgccgttactacggtggttgtgaatttgtcgatgttgttgaaaatttagcaattgatcgtgccaaagaactttttggtgcggcctatgcaaacgtacagcctcactcaggctcacaagccaatactgcagcatatctagcgttgattgaaccaggagatacggtgatgggcatggatctatccgcaggtgggcatttgacccatggctctccagtcaattttagtgggaaaacctatcactttgttagctatggcgtagacccagcgactgaagtgattgattataatgtcgtacggatcttagcgagaaagcatcaaccaaaattgatcgttgctggtgcaagtgcgtattcacgaacaatcgattttgccaaattccgtgaaattgctgatgaagtcggtgctaagttgatggtagatatggcacatatcgcaggattagttgctgctggtctgcatccaaatccagttccttatgcagacatcactacttctacgacccacaaaacccttagagggcctcgtggcggcttgattttgaccaatgacgaagacttagcgaaaaaaatcaacagtgcagtctttcctggcattcaaggcggacctttggaacatgtggtcgctgccaaggcagtcgcattcaaagaagcattggatgaagacttcaaatcctattcagagcaagtgatcagaaatgcgcaagcaatggcaaaagtgttcaatcaagcaccgcaagcacggcttgtttctggtgcaacggacaatcatttattgctgattgatgtgcgaggatttgagcttaacggaaaagaagccgaagcattgcttgaccaagtcaacatcacagtcaataaaaattcgattccatttgaaacccttagcccatttaaaacgagcggtattcgtgtcggcacaccggcaatcactagccgtgggttcaaagaagaagatgctgtggaagtagcaaaactgattgtcaaagtgttggaacaccctgaagatacggctgttttggaagaagcaaaagcacaagtgaaagagttgacggacaagtatccgttgtattaagatgtagcaggaaaagggtttgagccgatgctcagatccttttttgaaggaatatggctatgacgtgatgcaaggttgtatcaatcgttgatttgctttaaaataaaagaaaaaccaaaggagacttttaaaatgggtaaattccaagtaattgaccaccccttgattcaacacaaattaacaatgatccgcgacaagaactgtggaacgaaagtgttccgtgaagttgtcgatgaaatcgccatgttgatggcgtatgaagtatcacgggatatgcccctcgaagatgtagtgatcgaaacaccgatcgaagaatcgacccaaaaaacacttagtggtaaaaaagtagcaatcgtaccgattctacgggccggactaggcatggtcgacggtattctagagttgatcccagcggctaaagtaggacacattggtatgtatcgtgatgaagaaacccttgaaccacatgagtatttcgttaaattgcctgaagacatcgacactcgtcagttatttattgttgatccaatgttagcaactggtggttcagcgatcatggccatcgatgcgttgaaaaaacgcggtgcttctaacatgaagtttgtttgcctagttgctgcgccagaaggtgtgaaagcattgcaggatgcccatcctgatgtggatatctacacagcaagcttagatgaccgcttgaatgaacatggctacatcgttcctggattaggcgatgctggtgaccgtttgtttggaacaaaataaaagaaagagcgtggaacaaaaagtgaaaaacacttttgttccacgctctaaacacgtctaaacgctgggagtaggagcaactccttcggaaataaatcgaactactcaaaaactactcaaacatttgaaaagcaatttccgtgtattcctccttatttcttggagattaccacttttgtcccagtctccttttgaacgaactacattttcgttaactgtttataattaatgatcaatacaccattactttgtgtaacaagcttttgattctccgctgtctgattcaattcaacaaccgcagagttcttaagctgcttagtgactgtaccggtttgttttattccatggatcgtgaacatgacaggagtagcgacctcaaaatttgcaccttcagctgacgggacaacggttgtttcgaacttaccaaatgttgccatgtaaaaacctccttgatatagttaaattataccacattttttgaaaattttcagtaatcctattttttccctaaacttctctttacaaagttgtgtttttttcttataatcttctttgtgttagttgccagcttagctcagttggtagagcaacgcactcgtaacgcgtaggtcacaggttcgaatcctgcagctggcattgaagcagtctaattagactgcttctttttttagatgatttttttagagaaaactttaaagtttctaaattttttctgaatgagaacggggaatcctttcttttctgcgcaaacatcactataatggataaagattctacagaagagagtgtgggcatggaaaatacacgaataaaaaagaatgataatcgaattgactacggtgtgatattacccgtatttttattgtgcttgattgggtttgcgtcattgtatgtcgcattgacgaatgatccaaggaatccatccgtgggaaaaaccttaggatttcaagctttatggtatgtactaggagttatcgcaattatagtgatcatgcatataaaatccaagtggttgtggaagttgactccctatatttacggagcaggattgctggtaatgctgggtctcttgaagttctatgatgcagggttagccgactctacgggctcgcgaaactggctgcgttttggctcctttacgatccagccttcggaattgatgaagattgcctttatcatgatgttggcgctggtggtcacccatcacaatgttcgtcatcgagatcgagatttaaagacggatggcttattgatcgctaaaatgttagctgtaaccattccggtcctagttttagtcatgctgcaaaaagactttggaacgatgttagttttcttagctatttttggtgggatctttttgatgtcggggatttcttggcagatcgtgatcccagttatcgccgcttttgttttgatagggggcgggaccatctttttagttacaacagatatgggacgagagtttctctataatgtcggctttaaagaatatcagtttgcacgtatcgattcttggttagatccgtttcacgatactcaaggccagtctttccaactagcttatgctttaatggctattgggtctggtgggatgttcggtaaagggttcaatgtgagtgatgtctacgtgccagttcgtgaatcagatatgattttctctgtgatcggagagaactttgggtttgtcggcagtgcctttgtgattttattatatttcattttgatttaccgaatgattcgggtttgttttgatacaaacaatgaattttatgcctatcttgctaccgggatcatcatgatgatcttgttccatgtctttgaaaatatcggtgctaatattggcttattgcctttgacaggtattccattacccttcatcagtcaagggggatcggcattattaagtaacatgatcggcattggcttgattttatcgatgcgctatcaggctgagagtacaccaaaaaccttgtaaggagatagctatgatcacattttactggtatccgaaatgcagtacatgtaaaaatgcgaaagcttggctagaagcaaatgggattccctatgaggccattgacatgatcaaagaggtgcctacgaaggcgcaattgttacaatggatcacctctagcggcttgccagctcgccgcttttttaacacaagcggaatgaaatatcgtgaattaggtttgaaagagaaagtaccaacgttgtcaaatgaagaagccgcaactttgttggccacagacggcatgttgatcaaacgcccattgttgattagtgaagatcgctttttgatcaatgggtttaaagaaaaagaatatgaaggagtcttgttagaatcatggaaaagaaatgcttgagaaaaaaagataatttgtgggtactgttcaatggcaaagaatactgtgttggtttgacaaaagaagcacaagaagaattaggtgctgtgtcttttgcttctttgaaaaaagttggtacagccttgaaacaaggagatacgctagtggagttggaagcagaaaaagctgtcagtgaatttccaagcccattaacaggcgtgatttcttctgtaaatgaaaaaatcgatcaaaacgttgatatcttaaacgacagcgatgaaatgaacgcttggctagtcagctttaaagatgttgatccaagtcaatttgacgaattataaaacaagatccaaccactgatttacaaaaagaattgacagcagattgagacgttgctataatttgctcaataaatgaatgctttgaaaagaagagtacatgttcttgacgtacacagagagccctgtttggtgtaaatgggcaacgaagagaagatggaagatggtctttgagcaggatgggtgagtctaaggacaagcctatcacgggatgcacccgttactgtgcaacagtatgcgaagaaattcaagtactggaagaggctgttgatgcgagtcgacagtaaatcaaggtggtaacacggaagttgtgctttcgtcctttgtaacagtataatgtacaaaggatgaaagctttttttgtgtttaactagtgaatgaataaagaaagatgggaaatttatggcattaatcgaattgacccacgtaaagaaatcctttgacggtaaaagtggcgcagtccatgccgtcaatgatgtttctctgcaagtggaaaaaggcgatatttatggcatcgttggttattcaggtgccggcaaaagtacattggttcgtctattgaatggattagaacttccttcagctggtgatgtagtgatcaatggtcaaaatattttagccttgaagaacaaagaattacgagattttcgtaaaaaaattggaatgatttttcaacactttaacctcttgtggtcacgaacagtattggaaaatatcgaattaccattagaattggcagggatccccaaaatcaaacgccgcgagcgggcacaagagctggtaaaacttgtcgggttagaaggacgcgaaaaagcttacccttcccaattgtcaggtggccaaaaacaacgggtaggaattgcccgtgcgttagcaaatgagccagaaatcttgctatgcgacgaagcaaccagtgctcttgaccctcaaacaaccgaagaagttctggatttactgctgtccatcaacaaaaaactgaatttgacgattgtactgatcacccatgagatgaacgtgattcgcaaaatctgcaataaagtagctgtaatggaattaggcaaaatcgttgaagaaggttccgtacactcggtgtttcgtcatccgcaacaagctgtgactaagcgctttgtgcagcaagatttggagccagaagaagatcccgaggaattgcgtcaagcctttttaagagaaaatccccatggccgcttagtgacattgacctttacggaagacaatgcgaatgaaccaatcatttcgcaagcgatccgaaagtatctgattgatgtcaatgttgtttatggcaagattcagcaaacgaatgaaggctcttttggcgcattaaccgttctattgaccggtgaaacagcagaaatcgataaagcattgcgcttttttgcgcaagaacaagtaggcgtggaggtgatcgagcgtgggtaaatcattttcagaaacctattttgattttgaaaaaatcgattgggcaaacatgcaacaagcgacgatcgatacgttatttatgacattcttctctatggtactagtcattgtgattggactaatactaggattggctctttattcattaggtcgcaagcaaacatttggatcacgctttgcctataccttagtctcgattatcagtaacgtgtttcgttcaactccgtttatgatcttgatggttttgattataccgtttacgacactattggtaggatccttcttaggggcaaaagctgcgattccagcattggttctatcagcagctcctttttatgcacggttagtagagattgcctttcgagaagtaagtccaggtgtgattgaagctgccgaggcgatgggagcaagttactgggagattatttataagattatcattcctgagagtgtcccagcattgatttcgggcatcactgtcaccaccatttcaatgattggttacacagctatggcaggggcgatcggtgccggaggccttggttcattggcttggcaagaaggctttcaacggggaaattacactgtgacgcttgtagcaacagtgattattttaattattgtctttatcttacaagcaatcggcgactttttgacaaaagcaacagacaaacgctgattggctgaaaaagaaaaacatcaaacagaaaattgggaggaataaaaatgaaaaagatttttggttttgcaacaacagtattgttaacagtcgctttagcagcctgcggtacaggttcaaataacagcgccgattcaacatcagctagtggagaaaacacgaaattggtggtgggagcatctgtcacaccccatgcagaaattttagaacaagcaaaaccattgttggaaaaagaaggaatcgatttagaaatcaaaaccttcgatgattacatcttgccaaacaaagctttagaaaatggcgatatcgatgccaactatttccaacatatcccttacttgaacaagcaaattgccgataatggctatgactttgttaatgcaggagcggttcatatcgaaccgatggggttgtattcaaaacggatctctgacatttctgaattagctgaaggtgcaaccgtgattacttcaaattcggaatccgattggggtcgtatcttaacgattttacaagatgctggtgtgattaagttgaaagatggtgtcgatgctgaaacagcaacatttgatgatattgctgaaaatccaaagaaattagaattcaagcatgatattgatccttcattattggcaacggcttaccaaaatgatgaagcagacctagtggccatcaatgcgaactttgcttttgggatcgacttgaatccagcagatgattctgttttattagaagcggataattcaccatacgtcaatgtgattgccgtacgcagtggcgacgaaagcagcgataaaatcaaaaaattggttgaagtgcttcactctgacgaaatcaaagactttgtcgaaaaacaatggcaaggttctgtgaaaatcgttgatgcggacgctaaatagtttccttcattaagcagtacaaacagagcagtgacataagttaaaaacagacgaaacttactaaatgataaagagatttgaccttcctcgcaatcttgcgtcgaagacctcctgaatcgcaggagtaatctctttacgtttcggttaggtggtttgtttcatacttttgtcactgctcttttttaattccaatctagcaaaacagaacggttatgccaaatcatttcatacagcagcggcaattcagggtgcttttttaataattgatcgtagtgggggagctggctaagaaacagacgaatgagtgtgagggtatcaggtgaaagtgatccactccctttaaacaagatcagattgccttccaataaagcacagagcaagtggatttgagtgattttgacaagacagatttgaaaggagtcacttcccagacgttctttgagcagttctgcagcaaatatttggttcagcaagtaggtatcttcttcagataaatagaaggcttcaagtccaagtaattgtttccataagaaaagatagttgcgttcatggcgcaaataaaaggcagggacaaagttttttggaaaaactgtagctaatgcgatcccattttccagcggataaaccgcttttcttttttcatggattgttttgatacaaaagaaggcctcactggaactttttatcaagtgtggacgcatccagcgcaacaattgataatggaaaaaacggatttgtatttcgttcccttgtaaaagtggaaaatgcttgcgattcagagataagtgatacgctgccaaagaggatgatagagcagtgaaacgtcgattgacactggaagggctcaggtggcattttctgcataataatggataagtcaacgaaggttcttccagctgggtgttaagaatacggtagttactgctcttttttacaagagaagcgatgactttttttttaactcagtaaccgacattgcttccgtctgtaaataatcaagttggccttttttaatcaaaaatttgattggtaacttgatacctaactcgctggcgatcatccgtctaatagtcttgacggagatcccttgttgcagggctgcttgttggagggggagcggcctttctttgaaaagactacggatcagacgcaacatgcgcaacacttctttctcgagaaaatcctccaagttgtgaatcacctctttcggatgagattacatttattatagtggataactagtttcttggtttttttagaaaagaataatcatcaaagtttaataaataattttcactacaaagagacagatgtggagctaatcagcttaaaagagaaaaaaatgaagaaaataaggaaaaaaacagggattctggattcatagtagggaatgatggaaggggaaattgggtgatcctgcaagcagtgtcgcttaaaagcagactcaaaagaaccgcacaactgaatagctgaaaaatagtagggcaacactaaaaaactactaggctaagaataccttaagcctagcagaaagtgtctagctatccctccctcgctggagatttggtacgtaatgcagagaaataaattatagaaaatcagcttgcttcactaggcaataaaatggtttggcgctgaccatcatcataggcataaacggtttgaggcaaatactcattgtaagcaatcggcagatcgatacacatcccagcacggcgatcatcttgtgaaaaatgaatactaacacggccgtcattattttttacgtgaaaagttaatagattttctaacggaataacgcctttcagatccaagtcaatgatcagccataaactatcgatcaattctcccggcatggtttggacgataccgccagaagcatagcggctgcggctactgtcaaatggttcaaacatggttgttccctccttgaggataaagtcggtcgtgggtcggcaatcgaaagatagaatcaacttgtttaaaataagaccactcctcaaggaatggtcttattctttacttgtagcaaaaattattcttgatcttcaccaataacagctggttctgctgcttcaccgttttcgtcatcttctgaaagttcttgtgcttcagcaacagcaacgatttgttcttcggcttctgtgacgatcgtataatcatcatttttctctaaatcgcctacagtcaacgcgtcaccaatttcaagtccagtgacatcaacttcaatacgttcaggtaatttatctggtgttgcggatacaacgacactgtataagttttgtgtcaatacgccgccggctttcacgcctgctgcatcaccaactaaggtcaattcagcttctacctcagtttcttcattcatatcgactgagatgaattcaacatgggtcaatgcacgagtgaacgtgtctgattgaaattctttgatcagtgtatttactttcttgccttctaagttcatagtgattacggtattcaaaccattttcacgtagcagtctttctaattccgctgcattgactgcaatcggagtactgtctacttgataaccattcacgatagcaggtacttttccttcgtgacgcaatttgttccgtaatgaacgggggcgaacttctcttttcgtaacttctaatgatactgacataactcaattcctcctaaaatttcccgaaaaaaacgggatgtttttaagcaaattttgttaactctgcacattaagtggtacgtgagtaaaaacacgcaaaagggcagttgtttacacaactgccccagaaagttttggttcaacttttctccaccaggtcgtaacgctgtgtatgagaaactttatttactttactctttaaccttacgtggaaagtcgaagaaagtcaaatgaaatgatgagtcgaggatttgcaagcaattaaatctgagctataatagccaagatggagagaaaacaatgcgtatagacaaactgatagaagagcggttagcgacctctcgcaaagaaatgaaacgtctttttcaacaagggaaagtcttggtggatcagcaaatcgaacggaacccatctcgaaatgtcgacagtcgattgcatgaaatcaaggttgctggggtactgctgcaaacaagagatgtgtattacttactcaataagccagcgggggtggtgacagcaaatatagatcaccagcacgccacagtcattgatcttttacagccagaagaccgacaggcgacactttatgcagtgggacgtttggatcgcgatacagaaggattggtattgttgacgacgaatgggcagttaggctatgaattattgcacccaaacaagaaagtgccgaaacgatacgatgtcattgtcaatggtccggtaacagcggaagatgtggctgcttttgctcaaggcatcgtttttcatggaggtgtcgtttgtcagcctgccaaattgaccatagagatgacttcaggtaggcggtcctttgttcatctagagattgctgaagggaagttccatcaagtgaagaagatgtttttagcaagagggaaaaaagtgattgccctaaaaagagttgcaattggtcctttggaactaggggatctattgtccggagaataccggaatctcacccaatttgaattagaaagcctagcgaattattttcgctgagaaagaggagactatgacttataaaacactgttatttgatgtcgatgatacgattcttgatttccaagatactgaacatgaagcgctgacagctctttttgcggaacaaggtctgacgatggatctcgaaatgaaacagacttatcaagaggttaatcacggattgtggcaacaatttgaacaagggaagctgtctagagaccaagtagtcaatgaacgatttggcttattttttaaaaagtatgggcgaatcgtcgacagtgaagcgatggaaaaacactatcgttcttacttggatcaagggcataaattattaggcaatagtcagctagtgttggccgaattggctgacaagtttgatttatatgttgtgactaatggtgtctctaaaacccaataccgccgtttgtcagatgctaagttgatgccttattttcgggatatctttgtatcagaagatacaggttatcaaaaaccaatgaaagaattctttacctatgtttttgaccggattcctaattttgaacaacaaaaaacagtcattattggtgactcattgtcttcagatattttgggcggacatttgtcagggatcgatacaatctggctgaatcctaacaaaaaagcggcttcaacagttctcccaacctatgagatccagtcgttggatcaattgccatcgttattaaaagactgatttcttagaaatgaatagtaatttttcagaatttcgctataatagaaacagtgtaaattttagagacgaaagaggttaattgaatgacgaatggcaagcccattattattggtgtgactggtggttctggtagtggaaaaacaagtgtgagccgagcgattttcaatcactttcccaatcattccattatgatgcttgaacaagactcttattataaagatcaaagcaacttgagctttgaagaacggttgaacacaaactatgatcatccgtttgcctttgataccgatctattgatcgaacatctgcagaaactccttgcctacgaaacgatcgaaaaaccggtctatgattatgtggcacatactcgcagtgaagcaacgatcattcaggaaccaaaagaagtgatcatccttgaaggaatcttgattttggaagacgaacgtttgcgagacttgatggatatcaaactgtatgtagatacggatgatgatattcgaatcattcgtcggatcaaacgagatatggaagaacgcggacgaacgctggattccgttattgaacaatatttgacagtagtcaagcctatgtatcatcaatttatcgaacctacgaagcgctatgcagatgtcatcgttccagaaggcggcgagaaccacgtagcgattgatttgatcacaacgaaagttgcaacattcttaaccgaaagctgagcatcttttctttcgaaaacacttattaaagaatttttttgataaagcagtagtttttctttatcaattatggtaaagtatacctcatgcgacgagtcgagatggtctagctttgactgaccagattgataacagaggcacaaggagcgatccacctgccggatgcagggtgtcggaatattccttttgtggagatagggtattctactagtaatagtactgtgaataaaaaacagctttgaacattcatgttcaaggctgtttttttgtctatttctgtaggggatagcgatagatcatcgattcttctccccaaggatgatagcctgtacccatcagctcaaaaccaaatttttcataaaacgaaacaagatctgtacataaataaagggtcgagaaaccagcagtagcggcagattgcttgatagtatcgatcaaaagccgagcaccaccttgtctgcgatagtgaggatcgacatagagggcgcgcagccaaggcatcaaatccattcggctgataaaatcattcgtgatcagtccaccacagccaatgatcgaggggacagcagcggcttggttatccacgagtaggaaccattgcggtagatcggtatcagcaaaactgtgggtcaagctatcttcatacactttcatggatgcgggactcgcccattttgattgaaaataagcgatcgcttcctgtaaatattcaggatgttctcttaaatgaatgactttcatttttatcccacctttggcaaacggatttgaaaaataacgcctttaggttgtagatcacgtacactgatttgccctttgtgttcctccacgatttgtttggcgatggccaaaccgagaccatagccgccggtttcttttgaacgggagcgatcttcccgataaaagcgttcaaaaatatgtttcttgtcttcatcgctaatagatggacctgtgtttctaacttcgagcagccaatacttgttggaaatttctgacagcagtgtgatcttatctccttgacttgtatatttcagggcattatccaataaaattactaatacttgatgtatttttttggggtcgaagacagcagttgtcgtagctaggttttccaagacaaattgtttattattcattttggcaatctcttgaaacggttttgccagttcttgaatgaaaggagcgatggcaatggtttctttggctaacatctgctggttggaatcgctgcgggcaatcgtcaataaatccgctgtcaatccagtcaacctccgggtctctgctaatgcttgagcaatactttctgattcctcaatgatcgtatgattgggcttagtgaaggtgcgctctaaactgttttggatgatcgtcaaaggcgtccgtaattcatgagaagcattttcgacaaattcttgctgttttttccacgaagcgaggatcggccgcattgtcaatgaagaaaggtagtagctgataccgattgacaagatccaaaagaaaatcatcgataaaatcaaaattgtttgaaagttgttcattgcattattgatttggttggtattggccaacacttgaacataggctacccctgattggttcgtaggcgcggcaaccgtgatcgagtgaaacagcaaagtctccgcttcattttgatcgcttacggtcagtgattgaatcgtatttaaatgttccgtatctaatttgagtgaagctagctgagagaaacgtccgcctaatgattgtttgtttactatcgtaccgtcttctgaccaaagaataaattgggtgttgaaacgattggttccaggaatctttggcattgctgtattgggcggtaaggcaatggcttcgttttgattagcgttgttgatctctgcttggaccagacgtgtatcttggacggcttgttcaagggcaatatcggtttcttgatatgcagattgatcaaataattctagtacaatgattccgagcaatgtaaagatcaatgcaaaagcgctgatattgatcaagaacaatttaagtcgctgtttcttagagagttctttgttcattcgctaatctccttgcataatatagcctacattgcgcagtgtccggatctctttatcaataccagtatcccgaagatgtttgcgtaaattgctgatgtagacctcgactactgtgatcgttgtttctgaatcaaatccccaaatacggtcaaaaatttgctctttcgtcaaaataatgcctcggttttgcaaaaaataaacgagtaatgcaaattcttttccttggataggtaatagcttttcgtcaatcgttacctcattagtagagagattgcaggtcaatcctttatagaccacttggttttcattaaataaacccaatgaacgttttaacaaggctttgcaacgcatcaataattcttcccgataaaaaggttttgtcaaatagtcatcggcgcctttttgaaagccagcgaccttatcttctaatccatctttggcggttaagatcaagactggtgtctgaacagtgtgctgtcgtaattttgccaatacttcatagccattcatttctggaagcatcaaatctagaatgatcaaatcataaatcccactttgggcttcatacagaccttcactcccatcaaaagcttggctgatttcaccaatttctgcaacgatttctttaatattttctgataacgttctgtcgtcttcgatcagtaataacttgatcattctgtcacctctttcattataagcatagcatgagtaacataaaaaaaacttaaaaaagtgatttttgcttaagctgtctttaagtttcagcgtcttaaatagggactatagcaatcaaaggaggaaaataccatgaaattaaaaaaggtatttcaacgaaaagaaaccaagtatcttttatcgtctgagcagtttcagccgtttctgggtgcgttgcagcagaggatgaagattgatgaatatggccaacacacgattctatctctttactatgacacggatgattttcgtttcatccgtcattcgatggataagccaaagtataaagagaaatttcgcatccggagttatggtgttccatctcaggacagtttggtgttcctagaaatcaagaagaaagtcaatggcattgtatataagcggcgtgttcctctaagctattcagattatcaatcatggatacgaagcggggaatttcctaccactattcaaccacttcaaattgccgccgaaattcgttggctatttaaacaaaaccatgacttaagtccgcgcgttttgattgcctatgaccgcctttcgctttttgcatcagaagacagtgaatttagagtgacctttgatcaaaacattcgttatcgggaaaacaatctgacattgtctgaagggagttatggacaattgatagcgccagagattggtgtgttgatggaagtcaaagcaatgggggcctatcccctttggtttgttgaacaattgaatcagtatggtgtgcgcaaagctagtttttccaagtatactcaaacctaccaacgtcatttgtttaaaaaggaggatattcagaatgttatctagtttgttaagtgataccgctactcttgaatgggatggcttgattatttgtattagtgcctcactgattctgggtctcttagttgccggagtgcatatggtaaagaatgtttatacaaaaaattttgtcattacgttggcagtactgccggttctagtacaatcagtgattatgctggtcaatgggaatttaggaactggggtagcgattttgggcgcattcagcttgatccgcttccgttccgttccaggaggttctcgcgaaatcaccagtgtgttttggtccatggggatcggcttagctaccggtatgggttatgtcggttatgtggtggttttttcattcgtggtagctgcctttttattgatgctgtataccgtaccctttggcgaacgacgtaagacgagcgaacgggaattgaaaataactattccagaagacttagattatccccaactgtttgatgacatttttgagaaatttactcatacagccaagttggattcggtacgcacaacaaccatgggtagtctctacgagttacgctatcacttagtattgaaggatcaaacacaagaaaaggctttgatcgatgatgtacggacgcgtaatggcaatttacctgttgtactcggtaaagttgcggctaatcgtgatgaattataaggaggaagaccaatgaaaaaaatctacccattgtttttggcactgttactggtagcttgtgcgcagcaatctgaaacaaattcttcaagttctgccactggaacttcggaagcaacggttacgaatggatctacttctttggaagatacagattattatggaaagtatgaagaagaggatttggatgcttcttatgagtcatcttcagccatagcgataaaactggcgggttcacaaacggaagctggagaaggatttacagttgatgatcaaacagtaacgattacttcggcagggacatatatggtcagcggttctttgacagatggtcagttgaaaatcaacgtcgacaaagaagccaaagttcatttgatttttgctggagtaagtatcacgaatgctaacagttcagcagttgttatcgagcaggcagagaaagtcattacgacattagctgcggatacaacaaatacgttaacggatggaacgagttatacctttgcagaaggagaaaccgaaccggatgctgctttttatagcaaagacgatttgtcgatcaatggagaagggaaattggtcattgaaggcaattatagcaacggtatccgcagcaaagacgatttagtcttggcaagcggcacctatgaaatcacagcaaaaaacaatgcgatcaaaggaaaagattcggtgtcgattcgagatgggaattatactctgacgacttctgaaggagatggtatccaagccaacaataccgaagatgctacaaaaggctatattgggattgatgggggtatatttacgatccaaagtggtcgggatggtatccaagctgagacaaatcttagtattcaatcagcagaaatgaccgttaagacagctgatggtgcagatagtcaagcggtcgtcgctgatgaaagttataaaggaatgaaagcaggtggatccatcctactagcaagtggttcctatactatcgatagtgcggatgatagtatccacgccaatgattcagtcaccatcaatggcggggagatttcagcagcgactggagatgatggcattcatgcagacaatggtttaaccattaatgatgggacgattattgtcaacaaatcctatgaaggcttagaagcaagcgtcatcaccattgctggtggagatattcaagtgctagcaagcgatgatggggtaaatgccggcggcggcagcgacacgacggacagcggacaatttggacaagatagttttggaggaggaccaggcggtggcgatcaagcagacgatagcaaagaagttgtcatcacaggtggaaccttgtcaattgatgctgaaggagatggattggacagcaatggcaatgtcacaatgagcggtggaatcgtgattgtcaatggaccgacgcaaggcgggaatggcgctttagattataatggaacctttgaaattacaggtgggaccctcgtcgctgcaggaaccactgatatggcaatgaatgtgagtggcggaacacaacgatcagtggcgattactttcgatcaatctcaggcagcagacacgttgatcaccttgcaagatactgagggcaatacgttattatcctatgcacctagtaaggattttcaacatgtggtgatttcaagtccagatttacaatcagcagactatacactacttagtggcggcagcaatagtgaaacttctgtttatggtctttatcaaggaggaagtgtgaaggatgcttctgaattaggcacattatctttaacagataccctttcaaatttgactcaatctggcgcaactgccacgacaaaccaaatgggcggatttggacgctgatcaattctagtagccctcgttggaggaaccaaagaaagaatactacgaacgatgaccgctacaacttagtttattcttgctatacatgattggtaaaaagccattaaagtgtaacattctgaaaggatattctagccctccatttccgagattgaagcagacagtgtctaaagatatcgtggatagaccatgcctattttaaggtgtacttaagctagtaaacatatagtcaagctacgtttagtagaggaggatatgagatgaattttatgaaacgcggcttacaaagtttgtgggcaaagaaaggtcgaagtttgctgctaattgctgttttttcggcaattttgatttttgttttagcaggattgacaatccgcagtgctgctttagtcgcaaccgaaaacgcacaaaaaagcgtgggagcgacggtgacgctgcaagccaatcgggagtctcttcgacaaaacagccaaacagcttcttcagatacttcagagggggagtcgacaccgcccgatccaggcagtttccagaatacaccggtaaatcttagtgatgctcaagcaattgcagcgttaagtggggtagcatcctatagctttgaagcgagtacatcagccgatgctgtcagtggcattgaagctatttcaagtgaggatgacgaaagtacagcgacagaatctacggaggattcatctagagcaacgaatggccagccaagtgggatgcctaatatgcaaggaggcagaatgagcagcggcgattttcaaatcactggtgtttccgaaagtacgaactatacaagtttttcagaaggcaccgcgaaaattaccgatggtgaagccatcactgcaggagatgaagggacgaatcatgtcttgatcgaatcagaattagcagaagcaaatgggctttcagttggcgacaaatttgttatttctgatagtgaagacaatgaagtcgaagtaacgatcaaagggatctatgaaaccagtgaagttgggaacagtatgagccaaatgttcaattttttgaacccagccaatacattgtttgcatcctatactctcgttaatacattggcgggtaatgaggatacgttagattcggcgacttatacgttgagtgatccttcagaaatggacagtttcgttgctcaagctgaaaaactgattgataccgatacctacagtatccaaacgaatgatcaaatgtatcagtcgatgttgacaccattgaataatgttgcaagttttgccaaaaatataattgtgctagttgcggttgccggtgtcatcatattgacattgatcgtaatgttgtcgatcagagaacgcaaatatgagatcggcgttctgttatctttaggcgaatcgcgaataaaagtcattttacagttttttaccgagattgctatctgtatgttctttgcattgggaatcgctgcagctagtggcaatgttgtagggaatatcgtgggcgagcagctgttggctcaacaaacgacaacggaacaagcggacgcagggatgaatggtccggaaggaatgccaagtatgggcaacggcggtcctaatggcagaagcgggctatccgcttttacaccctcggcagaagtacaagagttagctattacggtttcattccaagaaatcggcttattggcattgttaggtgtagggatcagctttgggtccattctattatcttcagctggaattttgcgcctcaatccaaaaaaaatattggtttcctaggagggatagcatgacgttacaaacagaaaaattaggttattggtaccaaacagaatctgaagccctttttcgagaagtagatttgacctttgattctggaaaaatgtacgcgatccttggttccagcggttctggtaaaacgacctttctctcattaatcacgggattggacacaccaaaagaagggaatatttattacgataacgaaccgttgaacaaaattggattgcgagaataccgtcgtaaagatgtttctatcgtctttcaagcttataatttgttgccctatatgtcggcactggataatgtgactaccgcaatggcgattgccaagtcacaacaaacagataaaaaggcatatgctttggcaaacctggctaaagttgggataactgaagaattagctatgaagaaagttacccagctttcgggtggacagcaacaacgagtggccatcgtccgggctatatgctgtgaacatgagttgatcgtggcagatgagcccaccggtaatttagatgaaacgacctcaaaagatatcgttcaactgtttcaagaaattgcccatgaacaaaagaaatgtatcatcttagtgacccatgaacaagaagtagcgaaagtctgtgatgttgtttatgaactaaaagagcgtcaatttgtcatgcgggactcctaataaacttgttactgaaagactaaactcaaggctgtattttctcatcagagcggatacagccttgtcttgcatcttgcagcagaaacttctacaataaaaggaagggggcgagacgatgcgattactgatcgatggggatggttccccagtaaaaaacgaagtcattgaattaggtgcgcagtttgcattgccagttgtgatcgtcactagtgtcgatcactatacggccaaagaatatcctgattttgttcattttgtctatgtggataagggggccgatcgagccgactatgagattgttaaagaaattcaaccgggcgattttttagtcacacaagattatggcttagcttcacttgtattaccaaaaaaagcccgtgtttttcatcataacgggacagaatatttgccggagactatcgactttttattagggcaacggtatttaggaacacaaatgcgtaaagccgggaagcggaccaaaggaccgaaaccattcacgaaagaggatcgtcaacaattcaaacaagttctagagcaagaaattaaaaagacgatccagcagtaaccatcattgaggagactgctggatcgtttatttttttcgaaaacgatcataaaaatattttccggcaacggtgacgatggccacaaaggctatacaatagccaaagatacccatttgatgaacaaagctgccctgttggggacttgcaacgactaaaagagaggaacctaaaatcactgctgctaagataatgccaatcactagccgattgatcatttgatcaaaacggtccagcagctgtttttgatggcggatctcaatattcagacgatgcttgccagtagctagtgtgttgacagcagctaatgttcgatcagggagtcgactgagtgctcggagacttttggcactggctaacaaactttttttcatttcttcttcaagatccagctgctgcaaaaagtatttctgagcaaatggctgtgtcacttccatcatcgataattgagggtcaagtgcctcgattactccttcaagcgttccgaaagctttaatcagcagcgtgatgtcacggtgcatctgtagatgattgtcatgacagatagtgatgacttcagctaatactttttgcaaatcaatatctttgatcggcatgttgtaataattttcaacaaaagactgaagatcttgatagaaatccacttcatcgaagtttctttcccgacggcaaaggcgtaggacagctctaccaacttgttgggtatcttgagtgtacaatgcgatcaaggcatctgccagccgactgcgaagggtctggtccagatgtcccatcattccgaaatctaaaaagatcaagcgataaggcggcagtgtctcctcatcctgccattttaaggagtaatcaacaccgcctaaaacaccaactttcttttttacatggaaaggagctgtttgctgatcgggatccagtggttgcaagaagatatttccaggatgagggtctgcatggaaaaagccgtcttcaaagacttgcttcataaagttctctaccagcagggtaccgacctctttcttgatttcttttactgtccggttgggaaaaaattgttcattgttttttcgagcaagcaaacagtttaggttttctccttccatatagtccatgacgatgactttacgtgtacaccactgaggatagactttaggaatctcgatctgctgccagtggtgattgaagtgataaaactcttgcgcatttttcgtttcttgcagaaagtttgtttcattatccaatgagcgtcgaacttcatgcagaacgcttttaagatccaccacattcgtttctggaatatagcgaatcaaaggaatcgctttttcaaacaaatcgagatctacttggatagcggaaataatgccgggatgctgtactttgacaacaacttctttgccatcttttagagtcccacggtgagcttgaccgatagatgccgaagctaagggcttttcttgcaaagttgtaaaaatggctgtcagaggttgttcccattctgcttctaacagcgcctggacttgcggaaaaggatcgcttttgacattgtcttgcaagtgtttgaattcattgataaaagcgtcagataataagtcgctacggacggaaagcatttgtccgattttaatgaaggtgggtcctaattcttcaaaggctttgcgtacagcgaggggatcttgctgcttacttaaattttgaatcactttgtatttgagaaacacttgaacgatctgtctgagtctttttttcttagatggtgattcctgttccatacgggcacctctattctttaagtttcgctagtctaatagtacgaagaaatcaagaaacattcaactacggatgatttcagttgttaaaatcggcaagaaataatgtcgcagcttcgtttttgtgctaaaatgtggaagaattagttttggtagaaacaatgaatacaggaggaatttcttttgaaaattattttattatatggcggacgcagtgcagagcatgatgtatcgcttctatccgctttttcagtagtcaatgctgtatattataattactaccaagtacaattagtaatgatcacgagagatggccagtggctaaaaggctctttattgactgaagcccctacatccaaagaagtgttgaatctgacggattcggcttaccaagggacgccgatccaacctggtgagatcaaggaagaggatgcgattgtttttccgctgctccacggaccaaatggagaagatggaacgatccaaggttttctagagaccatcggcatgccttatgtaggcgcaggggttttaactagtgcctgtggcatggataagattatgaccaaatatatcttgcaggcggcggggattccgcaagttccttatgtacccgttcttaaaaactattggaaagaaaatcctaaaaaagtatttgaacaatgtgaaggcagtcttttgtatccaatgtttatcaaacctgccaatatgggttcaagtgttgggatcacaaaagctgaaaatcgggaagaattgcaaaatgcacttcaagaagcctaccgttatgatacacgagcgatcgtagaacaagggatcgaagctcgcgaaatcgaagtcgctgttcttggaaatgaagatgtgcgtacaacaatgcccggcgagatcgttaaagatgtagctttttatgattacaattcgaagtatcttgacaataagattgagatgcagatcccagctcaaattcctgaggagacacaagcgaaagcgcaagagtttgccaaaaaagcttatacgatgcttggaggaagcggcctcagccgctgcgactttttcttgacgaacaaaaacgaattattcctgaatgaattgaacacgatgcctggttttaccgagtttagtatgtacccgctgttgtgggaaaaaaccggtctgccatatggtgatttgattgaggaattgattcaattaggagtcaaccgttttaaacagcgtcaagcctttttaaccgatgtcgaataatcacaaatagggaaatcagttcaactcaaggtgaagcttgaaaggaccatgatcttccctgtttttaacttaaggagataaataagatgaatctatcgataaaagaagttgccgctttatttggcgtagaatgtgccgatcagacaatgatcagcagtgtagaatttgacagccgcttggtcactaccgatagtttgtttgtgccgttggccggaacgagagatggccatgagtttgctcaacaagcacaagaaaaaggagcaatcgctgctttttggagccatccgacaatccagccgccagaaggactaatgatcatcgaagtatcagacaccctagctgcctttcaaaagctggcaaaattctataaagaaaaactggcgccaaaagtaattgctattacaggtagcaatggtaagactaccacaaaagatatggtagatgcggtggtggcacagcagttcaaaacctacaaaacacaaggaaatcacaataatgaaattggtttgccactaacgattctgcatgcaccagcggatacagaagttcttgtattggagatggggatggatcatgcgggggaaatcgaggtcttgtcacacttggctcagccagatgttgcagcgatcacattgatcggtgaagcccatattgagaatcttggttctcgtgaaggaatcgcgaaagccaagatggaaatcactgccggcttagacccagcaggatttttcatgataccagcagacgagcctttattgaccccctaccttgcagagttgactcagcaggtagaaacatttggtttgggtgaaggcaatcttaaaggaacgatccaagaagaaacccaagaacaaacagcttttacggtagcggatcaagtctatacgattccagtgatcggcggctacaatgtaaagaatgccttgatcgcgattggcatcggtcgttatttggggattgaagaagaaaaaatcaaagcaggattggctgattttcaactgacaaagaatcgtacacaatggctgaaagctgcgaatggcgccgctattttaagcgatgtctataatgcaaacccaacagcgatgggattagtcttagacagtttcagaaaattgcctctgactggcagacggatcgctgtgctagcagacatgttggagttaggtcctgattcagcgaagatgcatgccgcgatggcggatcatttagatgaaaggttcgatttgatctttttgtacggtagtgagatgcaagcgttgaaacgtgcattggatcaaagccgcttagccgatcgagtccatttctttagcaaagaggaaaaagcggcgctgatcacacaactacaaaaagaactgcagcctacggatagcattgttttaaaggggagcaacggaatgggcctggttgaggtaattgattctctaacagcaatgtaaagtaagcgtgaaatcttgctgaaattttcattctgtgctatacttatttaatgccgaaagatgaagcacagaatgattactgtaaataaacattgacgttttgagataaaatgatggctgagacagaaagatttgttttagccttttataatgccttcgtgaagcggtttttcggtaacaagagaaagataagagatgggactgctcttgtgtttctgaagaaagtacgcttcgattaaagaaaacaggcatcatgatgatgaccaaattaggaggatccatttgaaatttaaagatctagaattatcaaacgaattattgacttctgttgagcgtgccggctttgaagaagcaacaccaatccaagaagcaacaattccccttgcgttgcaaggaagagatgtcatcggtcaagctcagaccggtaccggaaaaacagcagcattcggcttgccaatgttggaaaaaatcgacccagcaaatcaccaactacaaggattagtgattgcacctactcgggaattagcgatccaaacccaagaagaactatatcgtttaggaaaagacaaaaaaatccgggttcaagcggtttacggtggtgcggatattggtcgtcaaatccgtcaactaaaagatcgtccccatatcgttgtcggtacaccaggacgtatgttagaccatatcaaccgccacacattgaaacttggcacagtggaaacacttgttttggatgaagcagacgaaatgttgaacatgggcttcttggaagatatcgagaagatcatcagccaagtacctgaagaacgtcaaaccttactattttcagcaacaatgcctcctgcaatcaagagcattggcgtaaaattcatgaaaaaccctgaacatgttcaaatcaaggcgaaagaaatgacggctgatttgatcgatcaatattatgttcgttcaaaagactatgaaaaattcgatattatgactcgtttgttggatgtacaaacacctgagttgacgatcgtttttggtcggacaaaacgtcgtgtcgatgaattggcacgaggactagaagctcgaggctacaaagcggaaggaatccatggagacttgtctcaacaaaaacgaatgagcgtattacgttcattcaagagcggtcatttagatattttggttgctacagacgttgcagctcgaggattagatatttctggtgtgactcacgtctacaactatgatattcctcaagatccagagagttatgttcaccgtatcggacggacgggccgtgcaggtaaaggcggaatctccgtaactttcgttacaccaaacgaaatgagttatttgcatgttattgaaaatctaactaaaaaacggatgtcaccaatgcgtccaccaaccgaaaaagaagcttttaaggggcaattaggtgcagcaattgaacaagtagaagtgaaaatggatgaaaacgggttggataaatacctccaagctgcagatgatttattggaacgctactcagcacaagacttggctgctttgcttcttaaaacaatcgcgaaagatccatctgatcttgtccctgtgaagatcacaccagaaagaccattaccgcaaggaaagaaatctttcaataaaaatggtcgtcgcagcaacaacagcaacaaccgcaaccgtaaagacaacggcggcaaccgcagcggcaaagctcgaggaaattacagcaaagacggcgctcgcaaaaataaccgtcgcagcaatgacaaaaaacgcggcttcgttatccgcaacaatcaagactagtccttagaggtcgctttcagcacctttttcgacacaaaattatctgaacttttttcgatcaacctgccaatgtgtgccactgaccaagaggccacttggcgtgatcgatcattgttcggatattttttttgccctttttgagaaaagacggtatagtcaaggaaaactggagaacgagcctctcaaaaatttcttaaccatccattaaaccctttagttttgagtggtaattccctttttttttggtagaatgaaactaaaataaatgcagctgatgtattaaatagatagatataaaatcgtaatgaacagtcatggaataaaggttcttgctgaacagaaaaggatagaaaatgatcaaaggtatcgggatcgatgcagtagaattagcccgcatcaaagaattgattgaaaacaaaccgcaatttattcagcgtattttaactgagaaggaatctgaactgtttttcaagctgccaaaaaaaaggcagattgaatttcttgggggacggtatgcttgtaaagaagctttttcgaaagcttggggaacaggaattgggaaattgtcttttcaagatatcgaagttctgaccaacgaggctggagcgcccgttgttacaaaggcacctcaccctctacatcagacgtttgtcagtatcactcataccaatgagactgcctttgcgcaaatcttgttggagaatgaataatgccagagatagcgattcgttaagggaatcactagagaaagaaggaaagtggaatggtcgtttcaatccatagaccaacgaaagccattatagatttaaaggcaatcaaagaaaatgttgaaaatgaagtggcgcgtttgccaaaggcaacggatttatttgctgtggtcaaagcaaatggctacggacatggggctattgagacagcaacagcagctctagaagggggcgcttccggtttttgtgttgcgacagtcgatgaaggtatcgagttgcgggaagctggattcagtgaaccaatattggtgttggggatcgtttctgtggcagatatcggtttgctgagctactacaatctttcatttccagtaagtacgaacgagtggttgcaagaagcggctgctttcttgcaaaaaaatcctgtcaccaatccgctgaaggtccatttgaaagttgatacaggaatggggcgaattggctttatttctaatgaagagttactctcggctgtcaaatggctccaagagcagtctttgttcacatgggaaggggttttcacccattttgcgacggccgatcaagcagatgatacgtattggcaagaacaaaatcaacggtttcaaaccgcattggcatgtctgcctgaattgccaaggtatgtccatgccggcaatagtgctactgctttgtggcacgcagaagccgtagggaacatggttcgctatggcattgcgatgtatggattgaatccttcaggaacggcattgccagaaacatatccattgaaaccagccttgtctcttgtttctgaattggtccaagtgaaattacttgaaaaaggagccggaattggctatggtgaaacatatatcacgccgcaagcagaatggatcggtacggtaccgattggttatgcggacggctggttgcgaaaaatgcaaggattttctttattggtagctggtgagtattgtgaaatcgttggtcgtgtatgtatggatcagctgatgatccgtttaccccggtcatttcctgcgggaacaaaagtcacattgatcggcgaagataacggacagtgcatcactatgcaaaaggtagcggaacaattagagacgattcattatgaagtggcatgcacgctttctgcaagggtgccgcgagaatataaaagttagggtggtcctatggtaaaaaggggagacatttattttgccgatctgtcaccggtcgttggatcggagcaaggagggattcggccagtattagtgattcaaaatgatttaggcaatcattttagtccaacggtgatcattgccgcgatcacggctaaaatggctaagccaaaactgccgacccatattgggatctcagcgacttgtacagggattggtaaagattcagtgatcttgatggagcagattcggacaatcgacaaaagtcgactaaaggagaaggtttgtcatctagatgaatcaatcatgtgtgaagtcgatgcggcattaatgatcagtgtgggagtcgagacggcttattccacgtcgtcgattcattcatgatgctaggatatttgttattagcggcaacactgatactatttttattttatacttatcaacacttgcggcgctttttacgggaaactaaaaagaaacaagaagacgttgaaaaagggtattttttattgagccatacatatgaagatcaggaaaaagcaagttactatggtgtctttcagcaaggagaaaagacattgacattggagatgccattgcagctttacctgcacacaagcccaccgcaacgtggcgaattagtcgcgaaagatggcaaagtcattgaattcaatacgtgaatacaaaaaaactttccatcactatatgtgatacgtgaggaaagttttttgcattagcagggaaaattttagcagaaacgataaattaggaaaaagagcccagtgtctagaacaagatcgttcagtcttttatctttttttatattctgagatcagagtgttgcattcgtaattctactttcaacaagcctcggagatgagttgctttatacgcaaaattcagttatagtatgtagcgactattttgaaaagaggaagcaatgtgaaaccttcaatttatggattaaccaaagagtccttatctttgtggatgactgagcaagaagaaaagaaattccgcacgaatcaagtgtgggaatggttatatgagaaacgagtagcgacatttgaagaaatgaccaatttgcctaaatcattggtaactaagttaaatgaatcgtttgtgatcaatcctttgaaacaaatcgtcttacaagaagccagcgacggcacagtcaaatatttgttccagttacccgataatcatatgattgagaccgtcttaatgcgtcaggaatatggtatgtcagtctgtgtgacgacacaagtcggctgtaatatcggctgtacattttgtgcgagcggtctgctaaaaaaacaacgagacctaactgctggagaaattgtcgctcagatcatgctggtgcaacattatttcgatgaattgaatgctggagaacgtgtctcccatgtggtggtgatgggaatcggcgagccttttgacaattacgagaatgtcatgcagtttctgcagattatcaatgatccgaaaggactagcgattggtgcgcgccatatcactgtttcaaccagtggtttagctcataaaatcaaagagtttgctgaaaatggcttacaagtgaaccttgcgatttcactccatgctccaaataatgaagtacgaacttcgatgatgcggatcaaccgcagtttcccgattgaaaaactaatggaagctattgactactatttggaaaaaaccaatcggcgaatcacgtttgaatacatcatgctggatcatgtcaatgatcgaccagagcatgcgcggcaattggtcgaattgctcaagaataaacgcaagctttcttatgtgaacttgattccttacaaccctgtcagtgaacatgatcagtatgctcgcagtaagaaagaagatgttttagcattttatgacatcttgaagaaaaatggtatcaactgtgtgattcgtaaagaacatgggacggatatcgatgcagcttgcggtcagttgcgcagcaaacagatgaaaaagcaagtcactgcctagaaacaaataagtctgaccatgaaggcgggaaagtcgctcattgaacagacttttatcaaaaaacggtacaggagaccgttttttcaaaatcagaaaagtaggtgaacggcactctttgttgacagaccgctgaaaaaggccagctctgagacaaagacgggtgcggttcctgcttttgctgatttttttatttcagaaaagaactgttttggataacaacaaaggaaagcgatttctctggattttttcaaaattccgatactcatggcttgaaaaatcgtctatactataagaattgatagaaataaaaataacacacatgatgaaaggatgattccatggaatggatcaaattgattggtattttggtaattcttgtcggctttttgctgaaactcgacacgatcgccgttgttctgatcgcaggattagcaaccgcattagtttcggggatagattttactgatttcttatcaatgttaggaaaggcatttgtagacaatcgtctcgtgaccttattcctactcacactaccaatggtaggaatctcagaacgctttggattgaaacaacaggccgttgttttgattgaaaaaatcaaaggattgaccccaggcaagtttttaagtttgtatttgtttattcgagaactagcaggtttcttctcgattcggatccaaggacacacgcaatttattcgtccaatcgtaaacccaatggcgcaagccgcagcggagaacaagtatggcgaactagaagaagcagatcaggaaaaaatcaaagctcgggcggcagctaatgagaactacgggaacttttttgcccaaaatacgtttgtggcggcttcgggtgttttattgatcactggaacgttaaaatcattgggttatgacgtagccgccagtgcaattgcacaggcttcaatccctatcgcgctgatcgttttagtcattgctaccctttcaaatctggctttcgatcgcaaaatgtctaaaaatatggcgaaaaggaggaaaagtaaatggaagcaatcatcaataatattttagaattcttttatattttgatcggtctcttgtcaatcatgactgctgttcgagtctttaaagatgcgacccatccaacacgactgggtacagcaacattttggcttttacttggtatcgtttttgctttcggaaactttattccttacatcattgatgggatcatcattatttgtatgggcgtattgacgttcttcaagcaagttcgaattggtaaaatcgtggatgtcgatgaacaaaaagcagaacaagccgccgaaagaatcggcagtaagatttttatcccttgtatctcactagcagtcatcgcagttgcgatttcctacacacctttaggcggacaagttgggatcgggatcgcttctgttttggcgttgattttagcaatggtattgacctctgctaaaccaaaaacagtgctggatgattccgatcgtatgttccaacaagtcggtactgctggtatcttgccacaattactagcggctctaggcgtgatttttaatgctgctggtgttggagaagtgatctcccatggtatttcaggtgtagtacccgaaggcaatcgtttgattggtgtgattgcctattgtttaggcatggttttatttacaatgatcatgggaaatggctttgcggcatttactgtcattactgccggaatcggtgtcccattcgtaatcgctcaagggggagatcccgttgtagcaggagcactggcgatgactgccggtttttgcggaacattgttgacaccgatggcagccaatttcaatgcattacccgtcgcattactcgagatgaaaaattcgaatgcagtaatcaaaacccaagcaccgattgccgtgctgctaattgtgatccatatcggattgatgtacttttgggcattttagtggtaaaaaggaatagaaaggatgatcaatatgaaatgtttagtcacaggatttgatccatttggcggagaagaaatcaacccagcgttggaagctgttaaattattaccagaagaaatcaacggagcaaagatagttaaattagagattcctactgttttcggcaaatcagctgaagttgtacaaactaaaattgaagagatccaacctgatgttgttttgaatattggacaagcaggcggacgttttgctatttcacctgagcgagtggcgatcaatgtcgatgatgcacgtattccagacaacgaaggcaatcaaccagtagatgaagccatccagcctcaaggtcaacctgcttatttcagtcagttgccgatcaaagcaatggtagctgcgatgaaagaagccgggattcctgctgttgtttcaaatactgccggtacatttgtctgcaaccacatcatgtatcaagtacaatacatgatcgatacaaaatacccaacgcttaaagggggcttcattcatgtcccattcgttccggagcaagttgttgacaagcctggtcaaccggctatgagcttacaagatattgcgaaaggattggaagcggcaatcggtgcgattgtcgattatcaaggaaaagaagacatcaaagcaatcgggggcgccattcattaagcggcacgaacagattgtcaattaaaacgaattgatttaacgatagatagatcagacaactaggaatataacttgtaagaggataggttgcttgcgagaataggccgatgttgtctgatcttatttatttcaagtaacgagcaagtatgaagcgcggaaagtcatttattcgtctttttatcgatttattgatagaattcatctagtggaacacgcgaaatgcgaagggggcaaatcatgatcattactgaatttgatagagagaattatattttacgtgatcagctgatcgacttagccgttctaatttatccgtctacctatcaaaaagagcagcggacagcagaagaattactgcagccgaataaagttgtcattgcagctattgaaggagagcaattggtcggctttgtgagtgccttccaaaaaagcgacactatctggcagcaagagatcagcttagttgatccccgacatccagatgaacaaataggtgagcgtttgactgcctttttgcgagacgaagttgttgctgctggcggagaatggctagtttcttaagtcttctagttgaacattgcttgtcaaaacggacacagacagttatagtggccaagatgtttcttaaaactagtcaagagttggaacataagttgaaacaaatgatatccgaatgatcaaaaatgaaggtcgcaagaatcatcaagattagcgacaagacacggctgtaaagtgagtgtctttcattgattgttcggatatatgcttgttttttgtaacttatgacacaactctttttgttttttttaaaagaaaaaatagtctttaaaataaaaatgagaagaagatgaaagtagcatatttattagttttctagtaatatttagtagaaattcttcaaagttattgtcttttatcgtgttttttaatgctaaaaattgtaaaaaaagattgcttttttaataattattaattaaaatctaatctaacttcagaaaagagcgattattctgaaaattaaatcaattaaggagtagttcaggatgaaaaataaatgggcatatggattggttgctgtgtgcggcttagttttagcaggctgtaccacaggtggttcaaataattcaagcagcggatcagctgccagcagcgaaagcaatgcggaacaggtattcaatgttgtggttcaacaagaaatgccaagtgccgatttgtcccttgcgacagatacaatcagtttcagtgcgctaaataatgtatatgaggggttgtaccgcttagacgctgacagcaaaccgcagccagctggagcagcagaagaagcagaagtcagtgaagatggattgacttataagatcaaattgcgtgatgacgcaaaatggtcaaatggcgaacctgtaacagcagctgattatgtctatggttggcaacgaacagtcaagcctgagacggcttcagagtatgcctacttgtacgcaccagtaaaaaatgcggaagctatcacagccggagagaaagatccgtctgaattaggaatcaaagcagttggcgatcatgagttagagatcacattagaaaaggccactccttactttgactacttgctggcattcccatctttctttccgcaaagtcaagcggttgttgaagaacacggggatcaatatgcggcaacgagcgacaatgccgtttataatggaccttttgttcttaccggatttgatggaccaggaaccgataccgaatgggcatacgaaaagaatgatcagtattgggataaagatacagtgaaattagaaactatcaatgtgagtgttgttaaagaatcagcgactgcattgaacttgttccaagatggtcaagctgatgatgtcattcttacaggggaacttgcacagcaaatggccaatgatgaagcgtttgtctctcaaccagaagcaacgacctattattttgaagtcaatcaacgcgatgaaaaatcaccattccgcaatgaaaatttacgtaaagcaatttcgtatgccattgatcgtgacgctttagtgacatcgattttaggggacggctcaattgcttcgacaggtctagtaccagaaggcatgacctttagcccatccgacaatactgattttactaaatcagcaggcagtgttttagaatatgatgaggccaaagccaaagagcattgggaaaaagctaaagaagaattgggaatcgattctcttgaatttgatatcttagcctctgatacagattctacgaagaaaatcattgaatatgtacaagatacattgcaaaaaacattggatggtttaacagtaacgttaagccccgtaccattctctgttcgtttggatcgttccaacgctggagactttgatatgttgatgggtggttggggagctgactatgcagatgctagcagttttacagacttattcacgactggcaactcatataaccgtggtcaatggagcaatgaagagtatgatgccttgattaaatctgcaagtacgactaacgtcaatgacccagaaaagcgttgggaagatttagtcaatgcggaaaaactaatcatgagtgaacaaggagtaatcccagtttaccaaaaagcagaagctcatttacgtgcaccaaatgtaaaaggtgtcgttgctcatgcagcaggcgcacaatacgattacaagtggacatcgattgaataaccacttgaatgcctagcggctgggacagtaactggatacaagatgacgattatcgatgaatagctggaataacaggcataacaaaaatggagaagctgctgcttctccaaaatgccaagtgcttcactatttgtcacgtatggaaatcttctcttgaatacagtctcagccggcttttttttctaaagcagaaaggcagtcgacaaaagacacaaaacgataggttactaaattaaagagtattgattaataaaaagagcaaagaaagtagcagtaaaaaaattcctggccatagccaaaagccgtagctttgtttaccaacatcggagagtttaaggtaatcggttttatttttggaaaaagcttttttcattgaatattggaaatgatcaaagaacccagaggcaaagacccaaagaaaaccgccgatgatcaagaagaataaagcccaaagaaatagtgcatccgagatagttgacagggtcaattcctttttgaaaaacaaccagctaatggaaataagggtacatatgagggcgatcagcccactacttttttttatccgcataagttgactcctttttaatgattcgtactacttaatttacataattattgataagaagtcaaaatacctagggggaagacgcgtgaacggttttttgaaatatttattgaaacggatattctatatggtattgaccttatggttgattgccacgatcacatttttcttaatgcaatttttaccaggaacaccttataccaatgcagaaaaactgagtcccgaacagattgccttattgaatgaacaagcaggtttagataaaccgatgattactcaatatgggctgtatttgacgaatttagttaaaggcgactttgggatttcattccaattcaaaaatcaaccggtagcgaatctattatctggtcggattggtccttctttacaattggggctgcaggcaattatttttgggacttttttcggtatcattttagggacgatctccgctatgaaacaaaatacatggattgatacgacgtcaacgctagtagcgatcttgggacgttcgattccgaactttgtctttgccgttttgctgcaatacatttttgccatcaaattaggtgtcttgccaatcgccaaatgggaaacttttgcaagcacgattttgccaacgatcgcattagccatgtcgccactggcagactctgcccgctttattcgaaccgagatggtcgaggtgctccacagtgattacgttgagttggctcgtgccaaagggctgagccgctgggagatcgccttcaagcatggtttgcggaacagtttgatcccgctgcttaccttgttaggacctttagccgttggattgatgacgggttcattagttgttgagaatatttttgcgattccggggattggcgaacaattcgtaaaatcaatcatgacaaatgattatccaacaatcatggcagtcacgattttgtactctgccatgttagtatttgtgattttagtggtagatattttgtatggtatcgttgatccgcgtatccgtgtgtcagaagggagccgtggctaatggaagagaaaacaatcaatcaagtagctgccattgatgcagccaaatttcagccgttacaaaaaaataccaaagaagaacgagaagcaattgctgcgccatcgctgacctttttccaagattcatggcgccgtctgaagaaaaacaaagcagctgtattttcgatcgtactattgctgatcattattgcaatctcgattattacgatctttgtttctccccatgaccctactgcgcaaaacgtgaagttcacgaatctgcctcccaaaattcccggactcaatctcccaggattaaatgggtatgcaatggttggtggtgaattggttgataaatatgctgctgccaatgttccagaaggcacttactatctactaggaaccgacggactaggacgagatctgttgagccgtttatttgtcggaacgagaatctcgctattgattgcctttattgccgctttgctagatatcatctttggtgtgacctatggattgatttccggtttattagggggacgagtggataatatcatgcaacgtttcttagagatcctttctgggattccgaatctagtggtgatgattttgatgctggttgtcttcaaaccaggaatcttttcgatcgtagctgcgatggctatcaccaactggattccaatggctcggattgttcgcgcgcaaacaatgaaattaaaagatcaagagtttgtgctagctgctacgacattaggtgagagccgtatgaagattgcgatgaagcatatcttgccgaatatttcgagtgtgattattgtccaaatgatgttcagtatcccatcagcgattttcttcgaggcttttctaagctttatcggtttgggcttaaagccgccttcagcatcgctagggatgttactgagcgacgggtacaagacctttttattcttgccttaccaaatgtgggtgccggcggttacgttgtcggtcattatgatcggattcaacttacttgctgacggactccgtgatgccttcgatccgaaaatgaaagagtgattgctatggaaaaagtgttagaagtgaaaaatttagagatctcctttgatacctttgcagggaaagtccaagcgatccgcgatgtcagtttcgaactatacaaaggcgaaacactagcgatcgttggcgaatccggtagtgggaaatcagtaactacccgcagtatcatgggattattagctagtaacgccaatatagataatggagagatcctattcaatggaacggatattctcaagaaatctgagaaagaactacaaaagattcgcggaaaagaaattgcgatgatcttccaagatcccatgacttctctggacccgacgatgcccatcggcaaacaagtggccgaatctttgatgaaacataacaaacttagtaaaaaagaaggactccgacaagccttggatcttttgaatctggtagggattccgaatgctgagaagcgtttgaaaaattatccgcatcaattttcagggggacaacggcaacggatcgtcattgccatcgcattaatctgttatccacagatcctgattgctgatgagccgactacggcactggatgtaacgattcaagcccaaatccttgagttgttgaaagatatccaacaaaaaatcaattcatcgatcatttttattacccatgatttaggagtagtagcaaatgtggcagatcgggtagccgtcatgtatggcggcaaaatcgtagaggtgggaacagcagaagaaatattctataatccacagcatccttacacttgggggctgttaggttccatgcctaccttggaggggacgggggatcgtctgtatgcgattcctggctcaccaccagatttgttggatccgccgactggggatgctttttatcctagaaatgagtttgctttgcagatcgatgccgaacagcaacccccattctttgatgtttcaccgacccataaagcagctacgtggcttttagctccgcaagcacctaaggttacccctccggatgaaatcttgattcgttggaaaaaattccaagaaaaaactagacaggcatctgtataaaggaggagaacccattggagaaagtgttgcttgaagtaaagaacttaaaacaatattttaatgtcggtcgcaaagacgaagtcaaggctgtagatgatatctcctttcagatctatgaaggagaaacctttggactagtaggagaatccggtagtgggaagtcaacgactggtcgaacggtcattcgactgaatcatcccacggcaggagaaatcttgtttgatggacaagatgtcatgaaaatcaaaggcaaaaaagatttagctgatttccgtcgagaagtacaaatggttttccaagatccgtatgcatcattgaatcctcgaatgaaagttcgcgatatcattgctgaagggatcgatatcaacggattggcaaaaaacgaaaaggaacgcaaccagcgcgtagatgatttgttgaaaactgttggtttaaacccaagtcatggaactcgctatccccacgaattttccggaggacagcggcaacggattgggattgcccgagcactagcggtagatcccaagttcatcatctgtgatgaaccgatttcggctctggatgtttcgattcaggcccaaatcgtcaatttgctgcaagatttacagcaagaacataagctgacttatctattcattgcccatgacctatcaatggtcaaacatatcagcgatcgcatcggtgtgatgcataatggtaaacttttggaagtaggttctagtgatgaaatctatcattatggggtccatccgtacacagagagtctcttgtcggcgattccactgccagacccagatcatgaacgagaacggaagcgcatcaaatacgtcagcgaaccaacagatgacaagcctcgtgccatggaagaaatcgcagaggggcattttatttatgctacgaaggaagaagcggcacagtatcagaaaaaattggcacaaaaaaaggggtagacctgtttaggaggagatgaaactgagtgttttaaaagcatacaaatttcggatctatcctacagaggaacaaaagcagttctttatccaaacgtttggttgcgtacgcttcacctataatcaattgctaaaagcaaagatggaagaacttactacaaatgcagaaaaagaaaaactaacacctgcaaaattaaaaaaagagtatccttttttaaaagagaccgacagtttggcactggccaacgcccagcgcaatttggaacgggcttttcgcaactattttcaaaagcgagcaggctttcctaaactgaagacgaaaaagaatatttggcaatcgtatacgacaaacaatcaacaacatacgatctacttggtcgatgatcagttgaaattgcctaaattgaaatcattcgttgcagtcaagcgtcatcggccaatcaatggtcagattaaatcggcgacgatttctgcaagaaacaatactgaattttatatttcgattctttgcatcgaagaaattcagcccttgccgaagaaccaacgaaagattgccttggtttatcatccagaagtgttggtagaggccaatgcacagttaccctttatcagtaccaatgccatcaaatctcaacaaaggctggcccgtgcagaacgaaaactaaatgtgaaagcaaaagctgtcaaacgaaaaaaaatggtgcttagtcatgctcgtaattatcaaaaacaaaaaggaaaagtttctcagctatatcgagcgcatcgtgatcaaaaaaaagaatacatcgatcaagtaacctttcatctggtcaaacaatacgatacgatttttttggaacggctgatcgatgagacttgtagatctacagggaatttttcagtcagcgactggcatcagtttattcgtaaaatcacgtacaaagcagagtggtacggcaaagaagtccgatttatttctttgtcggccaaagagtgtcaaaaaatgacgcaaatgttgcgtgtaatcgaaagtgaaacgaactgggaggagcgccagggatcgcctaggggatagaaaaaatctttggatttttgtttctaggaattctgctcactaattatgattaaccagcgaagaggctgtgacgtcaggcaaaacaaaaaatacccaaacgatacacaaacccacagacgctggctttatgctcagctgaaagtgattcgtctatcgtttcggttcttgtttgcttgtgttgcagcctctttgcacggcctacattttgtcgccaagcacatcagcattcaattcatagattttcgaaggtcgtccaataccgacgggcttttcaccgatttccgtgaaatattgaagcatggcttttttgaaatttgaatggtcaatcaatttaaaatcgatccccaaaaatttagcgaagactttacgtgcttcagtgatcgtgaagttttcgccgagaaccagcagtacttgtggttcgtgttccattttgtttgccactcgttcaaatgctttcaaaataatcgcgctatggtcaaaagccaatgtatccttaccgacagattgtcccgagactaggtccaagataatctcaacatcgccactagataaaaagatttggttcgcctttctctctaatgaaaaccagcggacttgattggcatcatccccagcgctcaaaggttcttcgccgataaaagcgagataactgaccgtaatgacccagccccgcgggtctcgccctggtgtgctgaaggtatggagttgttcgatgttttgctttgagatggttacgccgatctcttcttgcgtctcgcgaatgacactttgaccagttgactcattcggattgacgaaaccacccggtaaagcccaagaatttcgaaagggatgcccttttcgctgaatcagtgcaatcttcagttcttcttcttctttgttgtaacacatcaagaccatatcgactgtcacagaaggcttctcatattttggctggtcctgactgcgataccaagttaaaaattctgcttcagaagcttctttttcataatactctttttctgctgtttttgaggtgaattctttcattcctgtctcctactcctgatatgatgaaataataatgatgatggattagttaaaaaaatagggaaaaatcaaattgataaaaaagagtgctaaatagaagaatgccgctttttgtgtgtgcttcatggctaaatatccccacacagcgatccatagcaggaacccataacgaagcaatgatgtgatgaccacaaagaagctagctagattttgcccattgaaatagccgtaaaaatacaaataaaaactagaaaaaatcaaatggatgatcgttaaaacagctaagatcatgaagcgctgttgttgttttttcaagcgaaaaaccctctctttcaaacgttcattcctattatagcaaaaaaacagctcataaaccaaaaggagctgatagtaaaatcatctcatcaatttgggcaaaagaaaaaaggaaaaactcacagaaaattatggtatactaccttagtatacactttacaggtgaaaaggaggacgtacgcccatggctgaaaaagaaacattttatattacgacgccaatctattatccaagcggcaaattgcatatcggaaattcttatacaacgatagcttgcgacgcagtagcacgttataaacgtctaatgggctttgatgtgttttatttgactggtgttgatgaacacgggcaaaaaatcgaaaaaaaagcggaagaactaggtgttgatccacaagaatatgtagataaaatggctgccgatgtcaaaaaattgtggaaaacattggacatcagctacgataaatttatccggacaacggacgactatcacaaaaaggcagtccaaaaaatctttcaacaattattggaccaaggagatatttatcttggcgagtatgaaggctggtactctgtctctgatgaagaatacttcacagaaacgcaattggcagaagtttatcgtgatgaagaaggacatgtgatcggtgggaaagcaccaagcggccacgaagtagaattagtaaaagagtcttcgtacttcttccgcatgagcaagtatgcagatcgtctggtgcaatattatgatgagcacccagaatttatccaacctgaatcccgtaagaatgaaatgatcaataatttcatcaagccaggtttagaagatttagctgtctccagaacaactttcaagtgggggattccagtaacggcgagtcctgaacatgtggtctatgtttggatcgatgctttatcaaactatattacagcactaggctatggttccgatgacgattcattgttccaaaaatactggccggcagatgttcatatggttgggaaagaaatcgttcgtttccatacgatctattggccaatcatgctgatggcattagatttgccattgcctaaaaaaatcttcggtcatggttggctgatgatgaaagacggcaaaatgtcgaaatctaaaggcaatgtcgtttatccagagatgcttgttgagcgctatagcttggatgctttgcgctactacttgctgcgggcagtgccttttggcagtgacggcgtttttacaccagaagactttgtttctcgggtaaactatgatctagccaatgacctgggtaatctattaaaccgcactatcgctatgatcaataagtattgtgaaggaatcgttcctaaatatgcctcaaaagtaactccttacgatagtgagttgtcgacaaccgcagccaacgtcgtaggtcgctaccatgaagcaatggacaagatggaattcagtactgcattgtcggaagtatggacgttgatctctcgtgccaacaaatacatcgatgaaacacaaccgtgggtattggccaaagatcctgagaaaaaagcagaattagacagtgtgatggtccatcttgcagaaagcttgcgaatcgtagcaatcttgctgcaaccgatcatgaccgaaacaccggcaaatattttccatcagttaggcttaacttcagaagccatggacttgaaagacttgcggttcggtgaatttcctagtgataccaaagtagtggctaaaggaacgccaatcttccctcgtttggaattagagacggaagtcgcttacatccagaagaaaatggcggaaggaacgcaaagcactgctgaaacagtcaaatggaacccagaagaaacggttcttgcttctgaaaaaacagagatcaaatacgatgatttcgacaagatcgaattgaaagtagctgaagtgatcgactgtcaaaaagtcaaaggagcagataaactgcttcaatttcgcttagctgcgggtgatgatcaagatcgacaaatcttgtcaggaatcgctgagttttatccagagccgcaagatttgattggtaagaaagtcgtaatcgtagcgaatctgaaaccacgtaagatgcgggggcaaatcagtcaagggatgatcctttccgcggaagataccgaaggacgattaaaaattgttgaagctccaaagggaatgcctaacggatcaatcattgcctaagcgagacagtatttaatcatttctgttcttttttcagaaaatgaaattgcaactgaatgaaacattttgtataatggtctttattgagatgatcatgagggagtaactggcagcttatcgttgcggcaacatcaccatcctgaaagaaatttctggtgttgccttaaatagtgagactcgtgtatgtgttttagtgcatacatgagtctattttttttcatttcatgtacaataaagaaggaagaagaataaaggaggaaaaacatgtctgaagagaataaaaaagagcaactctcgcaagctttttatgcacaagaagctgaggctgttctgaaagagctgcaaaccgatgccaacggtttgacaaatgacgaagccaaaagtcgtctgtcacaatatggcgccaatgaattagaagaaggtaagaaaaaatcgatggctcaaaaattctttgaacaattcaaagatttgatgatcatcgtcttgttagccgctgcgatcatttctgctgtcgtgtcacatgaaatcgtcgattcaatcattattttagccgttgttattatcaatgcgatcatgggcgtggttcaagaagcgaaggccgaacaagccatcgaagcgttgcgggaaatgtcgacgcccaatgccaatgtgttacgaaatgggcatacggtgacgatcaaaagcgatgaactggttcccggagatatcgttcttttagaagccggcgatgtggtaccagctgatttacgcttattagaagctagttctctgaaaatcgaagaagcggcattaactggtgaatcggtacccgtagaaaaagaattgactgtgatcgatgcaacagatgttgggatcggtgatcgtgtcaatatggcttactccaacagtaatgtgacttatggacggggaaaaggggtcgttgtcaatacagggatggcgacagaagtcggtaagatcgctggtatgttagcaagagccgaagaaacggaaacgccgttgaaacgtaacttgaatgaacttggtaaattcttgacgatcgccatcatcgtgatcgccgtaattatgttctttgttggtacgatcttcaataatacttcttgggtcgacatgttgctgacatcaatctctcttgcggttgctgcgattccagaaggattgccagcgatcgtaacgatcatcttagcactaggcacgcaagtcatggccaaacgaaacgctgttattcgtaaattaccggcagtagaaacattgggtgcgacagacatcatcgcatcagataaaacaggtacattgacactaaaccaaatgacagttgaaaaactttatgtcaatgacaagcaacatgctgcttctgaagacattccattggatacaatggctctgaaagtcatgaacttcgcgaatgatactaagttcggtgaggaaggcaacttgattggtgatcctactgaaacagcacttgttcaattcgggatggatcaaggcttccacgtgaaagatcaagtgagtgcagaacctcgtgtagcggatctgccatttgattcggatcgtaaattgatgagtacgatccatgaacaagaagatggtcgttacttagttgcagtgaaaggcgcgccagatgtcttattgggacgtgcgtcaaaagtcttgttgaacggacaagaagtaccaatgactgaagaagaaaaacaaaaaatcttgttcaacaatacagatatggccaaacaagcgcttcgtgtcttgggaatggcatacaagtatgtagatgcagtaccagaaaacttggaatcagaaatcgtagaaaatgatctagtctttgctggtcttgtagggatgatcgaccctgaacgggctgaagcagccgatgctgtgcgagtagctaaagaagctggtattcgtccaatcatgatcacaggagaccaccgagacacagcagaagcaatcgctggacgtctaggaatcatcaagcctggtgatgacgcagctgtattgacgggtgctgaattgaacaaaatgagtgatgaagagtttgcacaaaaagtgactcattactcggtttatgcacgggtttcacctgaacataaagttcggatcgtgaaagcatggcaacatgaaggcaaagtcgtcgctatgacaggtgatggtgtcaatgatgcgccagcactgaaacaagctgatatcggtgttggtatgggaatcactgggactgaagtatctaagggtgcttcggatatggttctggctgatgacaacttcgcaacgatcgttgttgctgttgaagaaggacgcaaagttttctcaaacatccaaaaagcgatccaatatttgttagcggctaacttaggtgaagttttgacattgttcttagctaccttatggggctgggatacactgttgccgatccatctgttgtggatcaaccttgtaacagatactttccctgcaatcgcattgggaatggagccagctgaaaaagatttgatgaagcatgcccctcgtggccggaattcgaacttcttctctggtggagtcatgagcagtatcatctatcaagggatcttggaagctgcaacggtattgttcgtctattggtcagcaattcaatggccggtacacgatacctatgatgcaatccatgcggatgcattgacaatggcgtttgctacactaggattgatgcaactgttccatgcctttaacgttaagtctgtttaccaatcattattcaaagtgggacctttccgtaacaaaacctttaactgggcaatcttgctttcctttgcattgatgatggtcatcattgttgttcctggattaaatgacatcttccgagtggctcatttagatctctatcaatggggaatcgttctaggtgcatccttcgcgatcatcccgatcgttgagatcgttaaagctgtccaacgtgcaatgggcaaaaaataagcagtctctaaatttattccgcaggcagagtattctgactgcggtttttgttcacaccaatcgtcgtaaatgaataataggggcgaatgaacaatctgcttttgccgaccttttcatttttggcaataaacggtaaaataaaagatagctaagaagaaagtaggggaatgaatcgtgcgaccgaatttaggtttttatgtacaaacaatcaatgatctagtgaaagagacagagaaaatcggggaaaccatgaatccgaattatgaagagattcgtcaggctctcgataaaaaaaaggaatctgaactatcaccagagcgtctggaaacaatcgaagcgtcctttaaaaaaggaacggacaaatatcgtttgatgctggaacagatctctaaattacgcccgcctgcaacggtcatggggattcacaaaaaatttgaacgagcatatacgaagtatgttgctggctgtgaagaaatgattctaagtattgctgatggggtcgatcgggaagctttcgatgcgtcagagaaaaaacaagacgaagccactgatgaaatctcttttgcaattcagcggatgacagctctcttgttaaaaaaatgataaagttcgtttcttaaacgagagttatttaatttaaatgttatgttattcttatgtaaaatgatgatggtggatgtataatgaattaacaaccaacaacctttttatttttcattttactccttttgccatcaggactaaccaacttgatggtttttttatttttataaatgtttttttactcaaaataataaaatgactgcaaaagacattgtgaataaatttacctaacagtttgttagtatcgtttcactgctaatctaaaaacaagtatcgccaattgcggtttttcgcggtagatgctatactgaaaacaacttataaacgaaatgagggatcctccattgaaaaactaaccaatttgttggaagctgcatagaatcatgttctctagggagcagtgtgcagattttcaggattggtgtgtttttctggagggtctttttgtgtacttttctggaacctgacctgaaaataggcgcggtttttgtctagagatagacaggaggtacaaaaatgtcaaatataaaaatagaacaattaagttttggcttcgatactcagaatcatctgctgttcgatcaagctgatttggtgatcgatacccagtggaaattaggtttgatcggtcgaaatggtcgggggaaaactactttactcaaattactgcaagaccaattgccttatagcgggactatcacccatcagcaagcattcgtttactttcctcaaccagtggcagatccgcaacaactaacctatgatacattacaagatctgtgtgaatttgagcaatggcagatcgagcgagagttaaatttgcttcagttggatccagatgtcctctggcgtccatttgagacattgtctggtggggaacaaaccaaagttttacttgcactactgttcatcgatgaggaacactttccgttgatcgatgaacccaccaatcatttagacattacagctcgtgctcatgtagctgcttatctaaaacggaaaaaaggctttatcgtcgtcagccatgatcgacactttgttgacgaagtggtggatcacattttatcgattgaaaaaagccgactagtgatttatcaggggaacttttctgtttacgaagaacaaaagcaacggcaagatcagtttgaacaggagcaaaatgttaaactgaaaaaagagatcggccgtttaaagcaaacggctgccgaaaaagcagaatggtcacgaggacgggaacgagataaactgggatcaccaacaaaaaaaggcagtggagcagtctatgacacaggggcgattggtgctcgggcagccagaacgatgaaacgatccaaagcaatcgtcaagcggatggaagatcaagcacaagtcaaagaacagttgttgaaagacatcgaatatatcgatcccctttctatgaatgttaaagccacgcatcacaaagttttgctgcgagtggaaaatttgcaattgacgtatgagcaaccgttgtttgatccgttgaattttaccatcgaagctggtgaccggattggtattttgggtgcaaatggttctggcaaatcgagtttggtggctggcctattaggtcattttactggaactgtcaccggctctgtttggatgccgcaacatttgtccatcagtcgtgttcgccaaaattacgaggataatcgaggcaccttgactgagtttgctgaattccaccgattggattatcaagaattgttgaataatctgaagaaattgggcgtggagcgaaatgtctttcagacccgaatcgaagatatgagtatggggcagcgtaagcgtgtggaattggcaaaatcgttggcaacccctgctgagctgtttatctgggatgaacccttgaattatctggatgtctttaatcagaatcagttagctgaagtgatccaacttgtccaaccgacgatgttgatcattgaacatgatcgccattttctggatcaagtgactacacaacaatttttgcttggacatacagatctagcgcgtccataaatcgaaccgggataggatttttttaaatcttatcccgattttgttattttaaagtggtaggtttttgagaaagataccctattttgatcgttagtctgtttttttgatttgagtggtctagataaaaaataataaatggggtgcctgttttttctttttttatttattttagctggattttttatttattttgcaagaaaaaaagccttactgtgcaatattctgtcgttcaacaatctcatttttttctcatcgttctgctagttaattaaaatttctatcataattaccaaagggttttacaaaagatttacaataacagtaccgaataaaaatattcatttgttatcataaaaatcgaatttctttgagcgtttgacaacagcctgtaagaattcagctgtttttgtgttcctatcttgctggtcgaacaaaagcggcaaagagaaaaataatggaggttctttttttgatagaagtagttgggttgaagaaggtctttgacaacaagtttgaagctttgaaagcggtggattttacgatcgagaagggcgatcttgtttgtttacttgggcctagtggctgtgggaagtcaacgattttgaatttgatcgctggattgttgagtccgacagatggggatatccgctttaacggaaattccgtggtgaaaacggagccaaaggatcgcaatatcggctttgtctttcaaaattatgccttgtatcctcatatgaccgttttagaaaatgtcatgtttccactgactgttggtgataaaaaaatcaagaaaaacgaagcgcagcaaattgctgaaaaatatatgcagctgaccaatattgaagaattgaaggataaaaaacctggtacattgtctggtgggcagcaacagcgggttgccatcactcgtgcattagtccaaaatcctgaagtactattgctggatgaaccattgagtaatttagatgcgcgtttgcgtttaaagattcgcgaggagattcgtcgcttagtcaaagaagttgggatcacgacgatttttgtgactcatgaccaagaagaagcgttgtctatcagtgacaaaatcattttgatgaatgaaggcgtgatccagcaaaatgatgatccgcaaaatctttatttagaacccaataatttattcgttgcaaagtttatcggaaacccaattatcaatatcttgccagtagaagtgacagatggtgtcatgcatcatccagaattcacgatccctacagagcgcttcgtggatatccgcttcaagaaaccgttgacagatggtcattatactttagggatccgtccagaagatgtgttaacgacgacccaaacaccattattcaataccgagataaaaagtgttgaactaattggtcgtgaacggatcttgaactttgatctggctgacatccacgttaaatcgatcgttagcatcgaagaaatcattgaagaaggagcacacttagcttttgacttcaattacaaaaaagcgttcatctttgatgaaaaaggggagcgagtttattgatgttcaagaaaaattataatcccgaaaatcaacccaaagcttggctgttcttattgccctcactagtcattattttgctctttagtgtgtatccattatttcgttcattgtttatgagttttcaaaaaggatcattgatcaatcagcgatatgccggattagaaaactaccaaaaagtgctgacggatccagtgtttttcaaggcgctaaagaatacagcttggtttgcattcgccgtggttcctattgcattagtgatttcactagcgatcgcttggatcatctttgaaaaggtgaaacataagagcttttttgagacgatcttctttatgccgtatgtcaccagtaccatcgccattgggatcgtgtttcgctatttctttaatgggtcttatgggatcatcaactacttgctgggcttagtggggattcccgccgtcaattggctggataatgtcaatatgagtatgccgacactgatcatttttgggatttggagcagtttggccttcaatattattattctcttagcagggatgcgtaacattgacaaagaacattataagatcgcaaaaatgtttggcgccaataactgggagatttttcgcaagattacttttccgcagttgattccgacatttgccttcttgttgaccgttaatatcatcagtgcctttaaagtctatacacaagtctatgccttgtttggtggtcaacccggtatcgccaaaagcgcaaccacagctgtctattatatttatgacaaattccatattgcgggccgtcctgggatcgcaatggctgcgactgtgattctctttgttattattttggcggtgacctttatccaaaataaaattttaaagaaagtaggggaataagatgaaaaaagtcgtaaccctcatctctctgatttttttggcgctcttagcgatcatcacgatttttccgtttatttatatgattctcgcgggactgatgacttatagtgaggccaccagtattccgcctacgattttgccggagtcctttcaatggagcaactatgccgaagtctttaccaaagcaccatttctccgttactttctgaatacagtctttgtttcagcagtcacgactatcgccacattgattactgctattctggcagcttttgcattgactagtttggaattcaaattcaaagggcttgtgattgctctaatgatttccttattgatggttccttatgaatcaatcatctttaccaactacaacacgattgctcaaatggggttgttgaatacttacagtgcgttgattattccctttctgacgagtatcttttatatttattacctgaatggctatttgaaaagcatttcgaataccttttataaagcagcaaaaatcgatggtgcaagcgatatggcttacatacggcggatattgatcccaatgtctaaaccggcactagtgactgttggcatcttgacctttatctcgagctggaattctttcttgtggccattgttagtcacgaatgaaaaaaaatatcggttgttgaacaatgggctagcggccttcacatcagaaagcggtagcgatgttcatttgcagatggcagctgcgacattgactgtcattccgattttgatcatttatttgatttttagaaaagagattattaaaggagtggcaaaagatggcatcaaaggctaaaacaacagttacatttcacagtggtattctcacgatcggcggcaccgtcatcgaagtgacatacaaagatgcccatattttcttcgattttggttcggagtatcacccagagcagccattacccgacgaagcattacagaccttagtggatcatcgctgggtcccgcaattgcgcaatgtctatgatcctcgtctgtcttatacgtatcatggatcagaacaaaaggactatcaagaaacagctgtttttctatctcatgcccatcttgatcattcaaagatggtcaattatttggaccctgcaatccctttgtataccttgaaagaaaccaaagcgatcctaaaagcattgaatcgcaccggtgattttttgattcctactcctcatgaagcccctgcctttgtgcgggaaatgattggcttggaaccccacgatgtgatcaaagttggtgagatcgaagtagagatcgttcctgtggaccacgacgcctatggtgccgcggcattgctgattcgaacaccggatcactttattgcctatacgggcgatttgcggttgcatggctatcatccagagcggacaaaagaattttgtcagttagccaaacacacggatctattgatgatggaaggagtcagtatcagttttcctgaaagagaaagcgatccagatactatcgaagtagccagtgagaaagaattggtagcggcttttgtcgagttggtcgaaaaaaatccacaacggcaaatcactttcaacggctatcctgccaatgtagagcgttttttagctttggtggatgcttgtcctcgaacgatcgtccttgaagcacaccaagcagcattactgaaagaaatctttgacagagaagttccctattacacggttgaaggcggagcttccttagcagagttagatcctgcgctagaaattgattatcgttctttatgtgtcgacactggccagtatgtctggcaagcagttgaccattttgaaaatttacaaccaggcagtctgtatatccatagcgatgcacaacctttgggggcttttgatcctgcctatgaagagtttctcgctttgttagcaaagctggaaattgagtttgtacggctgccggtttcgggacacgcagttcctgaggatcttgatcagattattgcgtggatcgaaccaaaaagattggttccaatccataccttgaaaccagagaaactggtgaatccgtatggcgaaagaatattgccagaacgtggcgagaaaatagaactataaaaggatagaggagagtaaagaatgaaatcaaaaaaactagcatttgcagcagtggctgcggcaactttagtgttaggggcatgcggcaacaatggctcaaatgacagtgcaaaaggcagcgatgagatcgttacagaggttccgaaagatactactgtcacattttggcatgcaatgaatggtgcacaagaagaagcactgacgaaactgacagatgagtttatggaagcaaacccaaatgtgaaagtagaactgcaaaatcaatctcagtactccgatttgcaggcgaaaatcaattcgacactaccttcaccaaaagatttgccaaccatcacacaagcgtatccaggttggctttggaatgcagctcaagatgaaatgcttgttgatttaggcgagtatatcgataatgatacgattggttggggtgaccaagaagaaattcgctcttcattattagaaggtgcacaaattgatggtgtccaatatggtattcctttcaacaaatcaacggaaatgttattctacaatgcagatcttttaaaagaatatggtgtagaagtaccgacaacattagatgagttaaaagaagcttcaaaaacaatttacgaaaaatcaaatggcagcgttgttggtgctggctttgattcattgaataactactatgctattggcatgaaaaacaaaggtgttgattttaacaaggatttacagctagacagcgatgaatcgaaagaagtcatcaattattatgcggaaggtgtgaaagacggctacttccgtattgctggatccgatcaatatctttcaggaccattcgcaaacgaacaagttgcgatgttcatcggctcgattgctggagaaggatatgtcaaaaaagacaccgaaggcaaatttgaatatggtgtctctgcccgcccagaaaaaatcaatctacaacaaggaacagacttatatatgttcacaagtgcatctccagaggaacgtaccgctgcttttgaatacatgaagtttttgacttctcctgagtcacaattagaatgggcagtttcaacaggatacatgccagttgttcaatctgttttagatagtgatgaatacaagaacaatccagatacgaaagttgcttctgagttaagtgaagcaacaaaagaacttttctcgatcccagtaattgaaaatgcagactcagcttacaatgaagttcgttccatcatggagaatattttgtcgaatactgacaaagataccgataacttgattaaagattccattccacaacttgaggatgtttggaatcaatagttctgctcgtaaaagggccagacaatgaccctatcaacccgaaagagaccgtcagatatccctgcggtctcttttacataaatgttagaggagtaatgagaaaatgcaaatcacctttcttgaaaccagcgacatgcacggctatgtctacccaactaatttcgccgacgaccacgatctggctattggggcagcgaaagtcgcaacgaaactaaagcagttaaaagccgaagctgatggtcctgttgtaatgatcgaaaatggcgattttatccaaggatccccactgagttattatattgccaaaagccagcatccggtagcagaattgaccaaagtgatcaatcacatggcatacgatgtccatgttttaggaaaccatgaatttaattatggattaacgtatcttcaagaggcaatcgctagttatcagtcccctgttttagcagcgaacatcttaaatgaagagggacagccctatttcggcaaagcctatacgatccttgaaaaagatgggattaagattgcggtgttgggattggtgacccagtatattcctcattgggaacaaccagctaccatcaaggggatgcggttcgaaagcattatccaaacggcaaaaaaatatgtgcctgagctaagaaaacaagcagatcttgtcatcgtcagctatcatggcggttttgagaaagatttggtaaccggtgaagccaccgaattgttgaccggagagaatgaaggctatgagttactgcaagaggtgccggggattgacgctttctttactggacaccaacatcgggaaatcgccgccattgtcaatggggtccctgtggtccagccaggttatcggggcagccaaatcggccgaatccaattaacaatagagaaaaaagagggtcaaacagtgattacggatcaacaagcgacattgcattcagtggcagaagtttcagccgatgaagcaattttggcaatgatcgaaccaattgagacggaattggaaagctggttggatcagccgctagggaaagtgaacggggatatgcgaattactgatccgatgcaggcacggatcgtggaacatccatacgtggaatttatcaatcgcgttcagatggctgccagcggagcggaaatatctgggacagcgctcttcaataatgaaggaaaaggcttcggtacaacgatcacgatgcgggatgtcatcacgaattatatttatcctaatacattggctgtcgtaaaagtgaccggagcagagttgcgtcttgcgttggaacagacagcgaattacttagccgtcgaagcagggaaaatcgtctttaatccagcctttatcgagccgaaaccgcaatactacaattatgatatgtacgaaggaatcgactatacgattgatatgaaccagccagttggcaaacgaatcacacgcttgttgttccataatgagcctatcacgccggaacaggagctggaagttgtcgtaaatcaataccgagcggtaggcggtgggaattacgcgatgtttacagccgacaaaattgtacgggagatccaagtggatatgactgaattgattgctgattatttgaaacaacacccagtactagaagctgagacgaatcagaatttcaaaatcgtgtactaaaaagccaaaaagggctgtgacataagtcatgcaacaaacgaacgattccgaggagaatgagactgtgcttgcgcttcagcaagtttccatcaccaatgtacgatggatgacacccagttatcctcggatcgtcttgtctagttgctacttatgacacagaccctttctatgttcttgtaaaagaaaatcagattagttttctacattgcggacatattcatcgaagtaacgaatcaaatcggcttttacctgctgatagtcttcttcgctatagtttttttcctctaattttgcttggaaaaaaggaagttctaactcttcttttaagcgctcaagcacttcttcttggttcatgagatcaccttttcgtctatttggtaccatcataacaaattgaatgcggctgtcaatgcttcatacatttctttcattttttccaaacgacttttaagagaaacaaagtcatcgtcatcatggaaaaggacttgtttcaattcaaaatagtaaatctcaaaagcatcaaagaagccagtaacttcggatgtttgcaattctttaaaggtatcacaacgaatataggctttttctgcaatggcataggtttcagccgtagtcaataagacgagggcttcattgtaacgacggctagtgaccaattcataagttgactggcacttattataaatatttgaaaaatctttcagtaaaagctcgatgggtgttttatcaaacatgggggagtcctcctgatcgttttatttttcaaataagacacaaacacattcaggcgcgtaaacgtctttttgaatagtagtgagttcaccagtttcggcgttgcgacggtacaaagtcaagttgtcggaattttgattggcacaaactaagaatttgttggttgggtccaagtcaaagtctcgcgggaagtcaccttctgttgatagacgttgaatgaaattcaagccagcgccatcttcagttacttcaaagacaacgagagagttgtgtccacgattggatgaataaacgaaacgtccatcttttgatactcggacagcagccccactattaaagtcggtgaaatcttctggtaaagtcggtactttttggatttcttcaaagctgccatcagcttcattgtagcgtaaaacagtcaaagagctgtctagttctcctaccagataagcatattggtggttaggatggaacactaaatgacgagggcctgttccggcagctgcaacataaacagccgcttctgttaattttccttcagcagaaacgtcatacgtatacacacggtctgttccaagatcacatacagctaagcgttgatccggcgttaagtctgtgtagtgtacatgagggttgtcttgattttcgtgaggaccaacaggttcatcatgatagatgtgatcagtggcttcaatactgccgtccgccaatattttgtagacgtttacttcacctttatgataattagcaccataaacaagttgacgaggttcatctactgctacataacacaatggtgcgccttcttcggtcacagtattcaacaactcaaatgcaggcgtataagcaccacaaccgcctgcgccatcaacttcggtcacagtatatactctttcttttttactgcgggcaagatacgttgggctcttttcttccgcacgcaaggtcaagtcgaccaattgttctttttctgtatctaaagtgatcgaatagatccctttactttcgcgacgcgtataagtgcctaggtagatcgtttgcaacataaaaaaagcctcctaatagtttgatttcttattaattctaccatagaatgcggaaatgggcggatagaaaaacttcttatgttataataaaaaaagaacataaaggggaggttgttgtatgaaacaaggaacaatcaaagcgattgggccacaagcgatcgatcaaaaagaaaaaatgctgatttttttcggcgaccaagcaacagagatcttaagggagtattcagtgatccaatcgattccagattctcaagatttggtcgtagaaaacggcgatacacttatttttggggatcagtcgtacaccgtgacacatgtcggtcctatcgcaaatcaaattttgcaaacgatccagcatgtgacatttatcttcgatgaagtacccgaagagcaactgaccagcgctatctatttagaacctttcaatttgccgacccttgaagttggtatgaaagttatctacaagtaggaggcggggaaatgaaggaaacagagaagcgccctttgtcctggttttggaagtggtttttaaataatcaagcagtcacgagtctattagtggttctactcgtcttattgatcttgtttatgtttacgaaagtatcctatctatttgagccaatttggcaatttctggcgattgttggattgccaatcattttggcggggattttgtattacttgatgaatcctgcggttgattatctggaacgaaagggaatcaaacgcatctatagtattttcggtctttttattttggtcatcggattgatcgtctggggcgttgtggtgattgtgccgaagatccaagaacagtccatgagtttcgttgagaatttgcccggatatttggatatcattgaaaataaagtcaatgagattttgtccgatccgattttctcacaagttcaagatcaattggaagcatctaatgagaagttgattgcatcaatgaccgacatcattcaaaacttatcacggagcacgattcaaaatatcggcagcttttttggggccgttgcaacggtggtattggctgtcataacgatgccctttattctcttttatcttttaaaagatggacgacagttagcaccttatttcgtgaaatttttgccgacaaaaatgcgtaaaccatcattgacggttttaaaagagatgaatgatcaagtttcttcttatattcgcgggcaactaacagtcgcatttgcagtagccatcatgtttatggtcggttttagtttgatcggcctagattatgccatcacattagggatcgcagctggctttttgaacttgattccatacctaggctcttttctagcgatggttccggcggtctttttgggtatcgtcggtggtcctgtcctgttggtgaaagtcctggtcgtctttgtgatcgaacagactattgaagggcgattgatctcaccactcgttttaggaaacgagttgtcgatccatcccgtgacgattttattagtattgctgacttcgggtaaactcttcggacttgtcggcgtgattctggggatcccggtatatgctgcggcaaaagtgatcattacccatatttttgaatggtatacgaccgtatcgagtttgtatgaagaagaaacggaaagcgatgttcagcaagaatagttcgaagaaaattttttgacgaaagatctttgtgaaaatcacactgactcacacatttttctagttttttatcggagtataaaaaagctgaatttagaaggctggagcgaattgcttcagcctttttgttatgtgcgatttttgacacatagttgcaagaaaaacatatagcttctgtttctagagaatgcttatactgaaagcacatacaagcaaaggagcgttggaatgaagattcttgcagtagatatcggagggacaatgatcaagacggggttgttgaatagtcacggagaaagaatacaattaggaagctttccgatgaataaagactattcaactgtgatcgaccgattgatttcacatattgataatgactatccaaaagacttttccggaattgctattagtacgacaggattagtagatccagtgacacaacagattgggatggattcaccgctttatgagggatttggtaatcgcatggtttcttttttaacggactattatcaaaaacccgtcatcgcggagaatgatggcaattgcgcgcttttagcagaaaaatggctgggaagaggaagaggcgctagcagttttgctgtcattgttttaggtacctctgtgggaggcggattgatggtcgataaccagttgattcgtggcaaacactttttagctggcgagtttggttatatgctgtttcctgaagtcgaaaagaaagattgggaaatttggagtattgccggtgcaacaagaacattggtagaacaagttgcagccgaaaaaaaaagccccctcgattgatgggtataaagttgttgcttactaccagcaaaacgatccggcagtgacgatttgggtggatcgctttattgaaaagctagccgtggcctgctacaacctacaatacattcttgatccagaaattgttttgattggaggcggaatcagtgaaagcgactttttactgccgctattagaaaagaagattcagcagattgcagcgcagattcctagtacagttcgattgccaaatgttgcctgttgccagtttgggaatgagtccaatttaattggtgcttgctacaattggttactgcaaacttttgaaatgaaaactagctaaaacagttgcaattctaagataaaaatgtaataaaaaaatagtctctatttttttattatgtaagcgtttaaattgcagcgaatgaaacaagggtcaggtgataaaagcgaaaaagttttacgatcaaaacgggcaaaacacgttcagagggatcgcgcgctcaatcagttcctacttgctggtattcctgatcccctttttaacggtctcgtggatttggtatgcgacttctgtcaaaagtatcaatgaacaggttgcattaacggcaaagaatcagttgattcaattgaaatactccttagagaacaacttccttcaattgaactacctgacccagaaaatgacggatgaccatcaactctcattaaattttttgacccatccctattattcaaaggaaggcaaagcaagcctgcaaacctacaagatcacgaatgagtttgtcgaagaagtttatttatactataaagaagaaccggagaactttttttcttcgattggcaaattatccgtcgaaggtttcttagaaaaagtaatcccagataatgatatgcagcaaggacagctgatcgatcagctagagaaagcttatccaacgttgctgactatcgaaggggcatcattggcacggcatcattcccgattcttctacattgtgccgttacaaaatgatgaactgactgtctatggagcagctatttatgagatcaaagaagctagcttagcaaaaatgctggacttgaccaatagtgatggtgcgagtacgaattatttgatcaatgatgagtttcagattttagctagcacaaatcataacaatttgacagtttttttgaatgatccccaagaaatggctcagatcaccactcaggacacctttcagtttaatcagcaaaagtacctcgttcaatcaattcccaatgaggaactgcatatctcagtggtatcggtgaccaatccatcacaagcattatcgctggtcaatcgcgttcaagaacatttcattcttatttttatgtgtattctattcgtggggatcattgctgttacattaatggggatcagaaattatcgaccgatccgcaaaatcgaacatttggttcgagaattccataaagatatggagatgtcggtcaattcgatggatgatgttcataatacattggctgctgttttagaagaacagcaggaactgcataaagaaatccagatgcagacgccgcatgctcgagaacaagttcttagaaagctgatgagcggtcgtctgcgttcggaacaagaagttgcaaggctgatcgaagccgttcatattcattttcctgcggacaattattttgtcatcacgatcgataccaaaaccgtggcttcaaaatataaagccggcgagagctgttttctgattgactatattgaagaaatcagcagccaagggtacacagcctacgccacagagatcctttccactgaagtgatcgcattgactgtgggatttgatcacagataccaacaggaagagatcgttcaagaagtcgcggcaaaaatagcagctgcgattggactgcttccagcaattggggtgggaaccatcgtcaatgaattgacggctatcaatgaatcttatattgaaggattagctgcattggattatcatgtcagtaacaaccagcaaatcatttattaccttgaaatttccgcagaagaacaacgctcggcgatccagtatcccgacagtcaaaaattaaaactgatccaagcattgaatcaaggaaatagcgatatcgcaattgaaacggtgcattggttaatcaaagacgggttaagtaaacaacgatctcagccggtccaaaagatgtatggctattatttattgaatacggttgcacaaactggaggcgaattagtgggagaggagattttgctatttgcagccgaacatgcagattttactaatctgatgcagctaggaacggtgttgcaacaattggtccagcatatttgcgaaaaagtgagggatcgaccacaaaatcaagaatcggagttgaatgaaacgatttttgcttatatcaaagcaaattttcagtcttctcagctgtcattggaatctattgcggaagaatttaaagtatctgtctcttatattagccgatttgtgaaaaaagaaagtggcaaaacattttctaagtatatccaagaactgcggttagaaaaaatcaaacaagaattagtcgaaaccgatctaccgatcaaagaaatcattcgggacaacggttattatgatgtctcgaactatacgcgtaagtttcgaacgatcgttggtgtaacaccaggacaatatcgcaaaatcaaccaaaaacgctgaaaatgcgaaaaatgaagggaaatgtgacaatgaaagaaatgactcaaaaagcgagagaactttatacttctattggtgtctcattagaagaggaaccaaaaattaagatcgaacctgcactaacggcagattttattcttgatgaggaacaaaaaacgatcactgcgaaagatccccagcaattattttatggtctgacaacctactatttgaatcaagtgacgaagaaacaacaaaaaaacagctacaccgcccaaatcaaggagcgctgcctaatgatcgatattggccgcaaatatttttccttaaaagaactaaaagcactcgttcacagtatggctttttttcagtttacccatttgcaagtccatttttcagaaaatgaaggatttcgaatcgagtctgaacgttttccggagattgtatcaaccgaacatttaacaaaaacagagatccgagaactaatcacatatgccaaaggttacggtatcgagatcattcctgattttgactcccctggacatctcaagcaagtcttagccacccatcccgaatggtgtttacctaacgcgactggtggggtcgatgctagggcattgaacattcttgaccaagaagctgttgctttcatccgagagatctacaaagaatacgcagagctatttgtagatagccattatttccatattggtgcagatgaatttgttgattttgaccgtctagaagagtttccgactttagttgaagctgccaaagaagcatatggaccagaagcaagtgggattgaagtattcattgcgtatgtgaatgatttggtggactatgtgactgacttaggttttgttgttcgtgtatggaatgatgggttttatcgcttgaatcgaaaggaacagctttccttaacgaaaaactgtgagatttcctattggacacgctggaatcaaaatatggcaccagtcgctctttattttgacaaaggctattctgtgatcaatcacaatgacaatttcttttattatgtagtaggtgaagctgcagggtatacgtatccgacctatgaaaaaataagcgatgagtttacattaacgacttttgccaacggacaacaagtgacccaagaacaactagcacaaaccccagcgatcgcattagcgatttgggcagatatcccagatgcaaaagaaggtgcggcagtgatcacagaagctttttggctgcaagctatcattagcctaaaagtttatgaagaaacagatccagggaaagaaacctttagccaactatttcagaaatggcagtcgttgttgactaaagagcagtaaagcgaaacgttctctaggaaaacgtgacttgttttaaagtggacgataagaagagattcctaagaagaatacatggagagaatacctaaagcgagtatttaaagcaagtacttaaatagtagacggcagtctagtgaatcttcgtcgtgggtttgcgaggaagatttactgtctgccgtctatttgctagagatattgtctagcgctttacggtattctttgttctactcttttcacttcaatgtaatctcaaggactggaatgagaacattaggtggcactaccggcagcgtgacgactagatcattaggagcaatgacagcttccgtagaagtgatgacttcattaggatcaaagccacgataaaaaatttcagagccatcatgcaagaagcggataaagcgaacttgatcagcaatttccggcaaatgaatatgtttgaagggatagctatatacatgcaaatagagtttcttgccattttgagtataacgacaatctttaggtaccgggtatttactaggaccacaatcgatgatagcttctttatgcagccgtatccatgcaccaatcgcctgcattcgtttgactgcccgcgggtcgatctctcctcggggattaggaccaatgttcaataaaaaattacccccttttgaaaccgtatcgatcaacattttcaccaacatatcacttgatttccattccaacgcatcgcgatcatagccccaagtcccgtacattgtctgacaggcttcccaaagaacaggtaaaccgtctttttccagtggtttttctggttgaaattgttcaggggtggtaattccccgaccaagttccaagcgatcattgatcagcatatccggttggagtgtccgacagattttttccagtcgcgaactgtcccagtcttctgctccttttcctttagaccagccccaatcacgatgactgtaaggaaagtcgaaccacatataatcgatcctgccatactgagtcaatagttcggtcacttgaccagcaatgaaatcttgataaataagcatatcccgttgagaattggactctcgagcggctaagtcacttctttgaggatgcaatccatcaatcgtaaaatgagggtggtaccagtcaatcagcgaatgatagagtccgattttgattcccacatcacgaaacgcaggcaataattctgcgagtaaatctcgcttaaagggtgtattggtgactttataatcggtccattcactatcccatagggcgaacccttcatgatgtttcgtagtaaagactatatattgaacaccgcaatctttagctgtttgggcccaaacagcagcatcaaataaattgggattaaattggtcgaaataagtttctcgataagtttcgggggcaatttcttcggtggtcataaaccattcgtggcgtgcaccaatactaaataagccaaaatgaatgaacaacccaaaccgatcatgaataaaccagctaggatcggggtaatgatcaggccaattctgaaatgttttcatagagatactccttaatcaatgaattcggtgtttgtcataaccgtttctttaatcttccactgcccattctcgagcacaaaggtatgatgggcttgggtaatatggtcgcgatagtcattctgtccttggttcactgttttttgctgtgcagctaccagcatggagtctgcttcttgtttgacaacttcaaaagacaagagttcatgagtcaaatcatatttcgcaaaaaaagcgtgcatttcctttgccgtagattctcttgcagaagtaacaagggtcgctgtgtagccctcaacgtctttctgggtggctgcctgcaggttttgctttagtacggtcagacacgcttgtgctgcagaagaatctgtaacggctcctgtaacttgcaaacgcgctacagtggtttctgctgaacgagaagttgtctgttgataaaaaaatagaccgcaaatgaaaagtaaaccaacgaaaaataagggataactcttttttttcatgcaaatcctccttgttttctgcactattttttgtactttttttgtacttatacatcagatatcttgctggcactataaatgccatggaaaagatttcttcccaaactgccgacacttgagggatcatctactggcaacagtggcatctctagttctggtaatctagtgatgtgaccatccaaatagttctgcaaacgccattgtgccatctcggcacgtttagatagagcgccgtagcgaagatcgatcacttcaaacccaaaggggcggttccattcaaaccacagatctctatgagattgatgcaagtgttgtaattcctgctgatagtgctgaatcatctcaagggctttttgaaggttctcacgttttttttcatgataggcttctgagatccagggactcaaagaagctttcaaagctagtaccaccgctaattggtgataaaagcggaacatccgttgtgtgtcctgtgtccccgtgactgcggccaatcgttgggccagttcctcataatgttgggtcaatggcacctctctgaatgtcttttcataaaggccataaagaatatcttgataaagcaataatttacttggatttgatccagaaggattttcggcagcaacaccgggagtttggtcaaaaagatccagcaaaagaaaatcttctgcttgtgatccatgaaatagtttcaagtgatctgtgactatctcccgcgatggcgtggcataaaactgggcttcgctaaataattgtagacctaacaagctggcaatcatcggggtctctgcgccgtcatctccccataaggtagcatagacttcagtgatgccatttgctttggcacttcttaatgcttgctccattgtagcgatggttttgccataattgggtgccagtccattccatgtccaaataccgccagcaaatactgtgggttggtttagctttttatgttcagcaaacagtcgttgatatgtttgaaaatcatgatgataataatcccagtacaccatgttgactgctggaatttgctgaatgacttctggaggaatgacgactgctggatcatagtaatcgcctgttggagaaccaatccgaaagaacatgtcactccacatcatgggttctaattgtagctgttcacagagagtgatgacgtgttttaaatgtttaatcatgatggcaaagcgatcttctaaaccattgtgttcgaggtaacggccttttcctaattggtgtgcttcatccataccaatatggattttatttgttttgaagcagctgcgaatggaacgaagagcggcttcaagaaaaatgtaagttttgggctcaccaactagcagaatgtcttccgtgtcacgtatctctttggcaaaatgccactttaatggatttgtcaaatgagcgagtgtttggatcgcaggaactaatgtaacgcctaattggtcagcgtaatggtccaattcccgcaagtcagattgactgtatctccctcgcaaatgaccaaaataaggatattcaggaatttcgtaagtatcttccatatatagcatgagactgttgagccccattttgctgctcaacaaaatgaaacgtttcaactgaggtactgtcagtactgcatttcgagataaatcgatcataggaccgatttggtcaaattgcggagtctcttcgtggacaaaatcggtatctgcttgcatccatagaaggagccctcgaaataaatgggctttttcctgatagtaaatcgtggctttttctgtattggaaatgattttcaatgatccttttcggcggatcaattcaagcggtttgccggtttctgatagtgacaagccaagttcaggagcaacgatttgaaaaaaagcggcgacgttttcgttggtgacaatctttatctccatgattcacttctcctttagtaaaaaatcgtcagtgttcatttgttagcaactctgttttttggatcgcttgataggcgaaccaactgattggccagagaagcaaagggatgaaggcaatgaataacaaaatcggcaaaaaggtagcggcgaatgtaaccaaaaacacacctaagatcatggcaatcgtttgtggcacactaacgatcattaaaagaaacgcattcctgaaatagacccaaaaaggaagatggtagcggacaaagaccggcagcaaataaaagctgatgagcaaaccgctgataaagagtaccgtcaatccgaaatggagaaaggcattttgcaagaatgtactggagatccgcagctcgatccatagcagcagcaagatcgccatttgcagcaaacctagttgattactacgccaaaaatttttggctgtctgttgtttgaaccaactataaagttcagcaggcagtggtttttttgcaaataattcaaagaaatagcgaataacagtagccgtcgctggaaagaagccaaaaatgattcccccccgtaagacaaaaaagaaccacaaaaaatgcaatcgaatcaccatcagcaaatagtcacccaaccggtaagatagatcaaataaccctcgtgattgtttcatggacacccctcttttaactaattgataaaaagtagaaaactactagccaaatagtagcaagaaatggaccttttagaaagcgtattcaaaaaattacatagccggaccagctaatacatacaccttcctaaagctatcttttgaaaacattcgattgcgacgaggagcgctagcccgcaggagcaagttttctagataaagagaaaagtacgacgaggagcgctagcccgcaggagcaagttttctagataaagagaaaagtacgacgaggaacnttcgggaaaagctccaaaaccttctgacctatgaagaaggcatcaccaacgcgatgatctatccttacaccaatggaaaaatagaagcgaagaatacccatataaagacaatgaaacgagtatcctacggatttaaatcatttgagaacatgagaattagaatctttttgatcaatcaattaatcaaagtaagataacaaaaaatctgagccagaatgaggttcattctgacccagatttgattttgtacaacccatcagtccttattgacaaagagccaaaaaaacgatgttgaaaatttcaacatcgttttttgtcttaagataaattctctggcttggtggaaaactgtccgcattccatcaccgttgttttcttcaaaaaaacgctcgccactcatcctcaaatactgaataactcagtcgctttatcgggatccgtatcataaacctcaaaggcctcaccgacacctaagtcatgttctttcatcgtattgaccatagttaggtgggctaactcttttaggttgttttctttactcaaatgcccgagataaactcgcttcgtgttatccgtcaatatatctgccatgactagtgccccatcttcattggatagatgtcctcgatcaccaagaatgcgctgtttgagactccaaggataaggacccatccgcagcatttctaaatcatggttgctttcgacaagatacgcatcggcccctttgatgatcccccgaacatgatcgctgcaataacctgtgtcggtcaacatcacaaaagatttgccatctttatggaaccgatagaactgtggtgctgcggcatcatgggaaacgccaaaactttcgatgtccatatcccccatcgtcaaaactttacccatttcaaaaacatgtttttgttcaaccgcaatattgcctaccatattatccattgcttgccatgtttttgtgtttgcgtagacatccaacttgtatttgcgcgccaagacccctacaccgtggatatggtcgcgatgctcatgggtgaccaaaatagcatctagatcctctggcttgcgtccaacttcatccaataatgaagtgatctttttgccgctcagtcctgcgtccactaggattcgttttttgttgctctcgatatataacgaatttcctgaacttccgctagctaaaatgcttacttgaaaggcactttccttcatcattgtttctgtcttcctctctcttactttcaacgagttccattatacctatttttctatggattttctactttttgtactgcattgtttgtaatgattcgattactaaaggcattgacagtttcgatctgaatatttacatccgcatctgctttgacagcaacgaaccaagccggaatgtagacattccgatcaccaacaatcaaaatccttgtgtaagccagctctgtccataatatcttagaatgactaggcaacttattattcaaataaagcgtgttgacggcttctttctctgaatagagagtcattttctcccgcagcggggtgatattggaaatgtgggtctgagtatacttagcgatctgcaacagtttatctgacgattctaaagtcatatcgatccgacttgagctatcattgaagggaatagtttcataggattggctagcaacaatggttggatattcttgatccaacagcgacaagtttttcctataatggtattcatctccataaagtacctggtctttacgctgcaggtattcattgaccgtcttttctgcctgagtatcatcactaatgtagaaaccacccgaggaaatatgagtcaactgttgtcctttgacagtagtcgcctcgactaaccgcttgtccccttgcgcttctttcaaagcagcagccaaatcggtttgttcaccgcttaaatagtacccgctcaaatactcgtcagaaagttctcctgaatatttaatgtcttctgaggctagtcgctgttcaatcgggatcgtctgatttgactgcaaaacgttctgctgttcactgcgggcttcactgtaaatgttgaacaaaaagacattcaaccccaaaaacgctaggaaaaaaatccattcgattcgcttgaaatccaatcaaactccccccgtttctgtcaatttagccattaattcctgataattgaaccagttattctcatactttacataccaagttggtgtcaaatcgacgacagaagcccctttgatgtcgccccattgatagccaacaataatctgctgcagctgatccgtctctgcccctgcagaaagcaagtcactgcgaacggttaagcttgaaggcagctccacctcggtctcagaaggaatcggcacttggatcgcatttaaactagattcgattgccatctctcgattccctaattgcccactgttagaaaaagttactttcatcaatccctgagcaccactgctgaagactggatacccttctacaaaaatacgataatctagttgattgctcaaccgatcaaaaaagcgtatcgttccgaaattgttgcccaaacgacgaatatagtccgcactttgcataaacagatccgtttcatcactttctgaaacagtggtttcaaatttgactacttgatcatcatgcaaaaccgccatattctgtccaccttcataataataagtatctacactatcatcattgactttgacatcttttggcgaagtaaaaaatgcttctcgaaagagattcgccgattgcaaagaggaaacatagctgtattttttcagcttgatcgtgtcctgtgtatagaactgattgctttttcctgattcttcctggcgcatcgctgtccattctcttggattatctttcaaaatgcgattcacatcatttttatcccagtcaatcttgccttcaatgatccgtgattcttccaaattcacaaactggattttattctctttcaaatcgatttgaatatgggagaaagccattttgttggcttcgttgtcacctaatgccaattcaacatcaaaggtctccgcgtaatcatttagtaagaacggcgtgtaatacgccaacgtcactccctcatccaatgttgctgcctctgaaaaagacttggaatcataattttgtaccgtcagatcattgacttgagcatccgagagcagtccctgaacgtcacgaatcaacgtttcagaattggtttccttgacttcatcttggtggatccaggttaaatacaatggcaaaaataaatcacttttttgtttgtaggtctgaatactcgtattgactgtatctgtagcttgttcgactgaacgatcgtaaccggtgggattcagccaaatcatgtaggaaaagtaaaagcttagggcaaccataacgatcagacctaaacgaatcattttttctgagactttcattcccaccaatcctcctcatacggttcatatggcaacatgatataaaatgttgaaccgcggttttctcggctttctgcccaaatggctcccccatgagatttgatcacttcgcgggaaatggctaatcctaaaccagtaccaccttgttgccgggcgcgggctttatcaacacggtaaaagcggtcaaagattttggtaagatcctttttagggatgcctaggccttgatcattgatactcaaaacgatattgttatgggtttccatcaatttgactgtgatcacaccgccatcaggtgaatatttgatagcattgttcataatattgtcgatcacttgaatcatcttatccgtatcgacttcgacccaaagttcacgtttggtgaattcacgacgaatcacatattttttgttctcattcgtcaccatcatatcaaatcgatccaacacaaagctgactaactcattgaaattgatgtattccaattgcagttgcgcattgccgctgtccattcgtgaaagactcagtaggtcattgatcattcgaatcatccgatccgtttcatctaatgtcactttcaagaagttcggtgcgatttctggatcttgccaagccccttcgctcaacgcttcaatatagctgcgcatactggtcaaaggtgttcgcaattcgtgagacacattggatacaaactctcgccgctcttgttcatttttctcttgttctgtaacatcatgcatcaccgctactaaaccagaaataaatccagactcacggcgaatcattgaaaagtcgattcgtaaaatcaaattcgttccaacgatgtcattgttcggccgttcgatcagcatttcatcaggactttctagcagtttacgcaaggtgtattcttcatcgatttggagcagagtcagaatcgattgaccgactgcttcttcagaagtaacattcaataacgacatcgccatctcattgattgtaatgactttcccacggcggtcagtcgctacgacgccatcggtcatgtgggagaggacactatctagtcgatttcgttccgactccattgcttcttgtgtttcttcgatacgttctcctagctgattgaatgtttcagccagctgtcccagttcgtcttggccatgaactgctactttgcggctataatcccctttggcaatccgaatggcttgttcccgcatttccccaatcggctgagtgatggatcgagaaacaagtagggcaacaacaattgagatcgctgcagcaattaaagaagccgtcacaaaaatcacggcagtatcactgacttcactgtatttctgttccagattgcttcgcaggtacaatgtacctaaaaccgtatcccctgtaggcgactggatcgattggacaatgttgtagacccgctgtcctgtcgattcgtcatacaacacttcactacggttcgtatcataatctcggtaatcgtttttttcacccactgaacctcgatcattgatattggtggttgcccgaatgattccttgttcatctacgacccgcatctctaaaatctcagaagagttggtactggaaaggatccggttcaaagaagaattcattgcatcccaatcgaggctgtcttcggcgtccattcgactaagttctgaacctagagtaacgaccaacgtgctagctcttgcctccatgtcgcgcttaaaggcatcgatcgttgttttctctaattcgcgaataaaatacgccccgataatctggatcgaaatcaataagatcaagataaaagtcagggcgattttgaagttcactgatcgaaaaaagcgaaccttatttttcatagcttattcctgttcagggttccgcaagtaatagccgactccgcgacgagtgaccaaataattcggatgacttgggctatcttcgattttttcccgtaaacggcgaacggtaacgtcgacggtccgcacatcaccaaaataatcatatccccagacggtttgcagcaaatgttcccgtgtcatgacttgacctaagtgtttcgctagatagtgcattagttcaaattcacgatgggtcaattcgattgcttcgccatttttagttaccatgtacgcatctggatggatcgtcaaatcaccgatcgtcaattctgcattcggtgcttcttctgcttctttcgccgaagcagaaccgcgacgtaaattagctttgacacgagctactaattcacggttggagaagggcttagtcacgtaatcatcggcacccaattccagtcctaacactttgtcgatctcagaatctttggcggtaaccataataatcggcatatcgtgattttttcgaacttcacgtgccacttctaatccatccattttcggcagcatcaaatctaataaaatcagatccggttcaacttctgccactttttctaatgcttcttcaccatcataagctgtatatacttcgtagccttcttttgtcaaattgaatttgacgatgtccgagatcggtttttcatcgtccacgactaggatctttttcaaaaaatgtcacctcattttttattctttcctacttattatacatgatttaggatgtgttttcatctttcctcaaatcttagccttgatctatgcttattcttaagaaaattttgtatcgatgttctttctttttcatactcatgattgctaacttattcattccgtaataggtttcacaacaacttttacagtatcgccaatgtcttttttgatctgtttgcgaatctctttcttgattcctaaaatataacaaatacttccgtcttgatttttcaactccatattgacgatacttccttgatagtcaacgccatcaaatgttgcctgaactttcagccgccctttattccattcagcccgcaaatcgtaaggaaaaatcacgtatgctccacctttaccaatctcagaagaataaatggttgattcaaaaacatattctttcattgtcactcactcctttttcataaacaactcaagatactgccttaagtaatccggatagcataaagctccatctgtaagcatccgtctccttggagaactgttgctttgttctatgaaatcattatactgcttgttttgttcaacgaaaataacttaggagtaaataggagcaaaagagagcaaaagagcgccaacccttcatgtcactgaccattgcggcatctctagagaaacaggtttcttttcactcatcggcacaaaaaaaggtatgaaagttgaaaagacaactttcataccttttaacattcattaatgaatgattgtgagcggctcttagaaaacgatcacagtcactcgatcaaatccccgtttcgtctaacagctgcactccgacgcctaataatccaggccctgtatgcacaaccaatgccggtgaaatctgtccaaagaaaatttctttcacttgaggaaattcttgttcaagacgagttttcatttctttagcttctgccaacgcatccccctgggccacggctaggcgaaattgtttgtgatttccaatgtactgtttcaccagttcaacggtcttgtccaaactctttttacgtcctcgtgatttcgctactgtgtaataaatcccttcgtcattacaagaaatgattggattcaatttcaaggcatttccgagaattgaagcaaccaaaccaattcggccgcctttttgcaagtactccaatgtcgctacattgaaaaagaccttatttcggacaacttcttgtagcagctgttctttgagctcttgccatgtgactccctcattcagcaactcagcagctctgatcgcttgtaatccagcaccaatcccgatatttttcgtatctaaaacaaaaatatccaagtcattccgttgttctcccatcaagcgaacaacattataagtaccgctcaacccactagagatggtgactgccagaacttgttcatagccatcggctttgatccgatcaaatatcttgttgatggtttcaccatcgggcaatgacgtactaggaatttcttgcggcaatcgttgatagatctcttccgctgtaatatccactttatccgtatacgtccgatccttgtatatgatctgcaatggcaacatatacataccatattgtgacatgatttctgccgggacatcggttcccgagtcgacaagcagggcaattttctctttattcatgggattctcctttgtgcgtttccaagtaatttacttctagttcaatcgttttttctgccaataatttatttgcaaacgaacgggtcgcccctttgatcgcgatcagttctactggaatcggatcggtagacaccgcttcttttgaccctgctgcctcttggcagactgtccaaatggctttttcctgttcttcacaaaataaattgtacgcatttcgtatcccgactacttttccttgaaacaatattcccgtcttgatttctgggattgtcaacacttgcttcaacatcgtaatggcaatcaaaaatgccaaatgtttttggttataccgttttttctctgggggtgggatcatcccttttttgacgtaattattgaccattgatgatgtcagcagtgaatgtttttccgactggattaccggcgacaagtactgatcgatcaacgtaatgacttgatccatgtacagttccaaagttggcagctcttcccaccgcggcaaatgaaaggaattcagcgactcgctccaatcaaataaatctgaacgtaatttttccataatcttctccatcttaaatagcagaatattggtttatcaaaaactttttatctggttttgataactagataaattttaccatatactggtattggattgtagtcctctgctcaaaatttaggaaaacaaaagaatttgatttttgaaggggataagtattacggagtatgtactctatgggtagtcttcttttgaaacgaaagataaaaaaacggatttttttttaacagaacgattgatttttaaaagtcggagtgctaagataataaagtaattttgatacgggccgttagctcagttggtagagcagctgactcttaatcagcgggtcgcgggttcgagcccctcacggcccattgggtgccaaacccacgccacataaggtttcttggctacttcggtagtttagaaaagaaaccttgatgtggctttttttatgctgtgggtatactttgtgggtatataaatttatcttcttttattttataacaattctgtgcggaacttatttttgaggagtttcgcctttttttgtttacaaatagaacataggttcgtataattcttgcgaggagtgattttaaatgtttgaagatatgattgcagaacaaattgatgcaaaacttgctaacgaatactctaccctttctgacgatgataagattttcttagatttatccattcttgctgtattagctcaaagcgataaatctattgctgtaaaacgtgaacgctttataaaaaatggcaaattttatgatcgtatgataattgaatctccactaaaaattagaagtaagaagtagttatcatgaaatcattgagaggtgtagtttcgaagatacgagtgttgaaaatgtcgaggacccctttagtgcgtttctctcttgacggtacgaattgtttgattgcagcacatagtttaaacttcttggcagatgtggatgagggaatgcaggttgtggttgctggtgagtttaacgatcggaagcaatttgttgttaagaagtattcggtgattggcaagacgaagattatgattgagtttgagtctttaaataggacgttaaatacgctataatgattacgatgtagaaacatagtttcacttgcgcagtgtgtgtaaatacgctgtgcttttttgtgcaaaaaaaacgacccaccctccccgagagagagtgggaacttataaagaagatttggaaattaaaaaattggttggtacttacattctatacctggcccttgagtaattcaatactaaaggttaatattaaattgcatatgtttaaaaaacataaaagtcatatgtacatcttaccaaaaagtaatgcttcttattggaaaattaggtacacttaaaatgaagaggattaggcacacttccccaagtttcccccgcctaatcctcttcattgacgatttaatatcgccttacaaagtctacaataaaataatttttaattcaaatgaaaagaataacgtttaatatttcgtttataagctctccgcagcgggctatttgtttaccatggattcttgttgttgctgttcaattaacattaaaaatcaacaatatgactaatttgaatacgtcatattgttgatttttatcatctttagttcctagttgtcggtattcgtcgataaatgattaatttatttgcacatttatttatgccttaggatccccagttagaaaaactgttcctttatatattttttttctggtacaataaaagaaaaaccttgaggtaccgtatgcatcgtaaaaagataaaaaaaacaaaaatactaattccattcttaatatttttagtaattctttcttcagtaataacattttacttaataaaaaacactaacgattccagttcaagggtatactcccatagaggagcctctggagaagagattgaacacacagtcgctgcttatgatctggctattttatacggatcaaaatatatcgaacaagatcttgtgacatccagagacaacactctttatgtttctcatgatttatcagcaaaaagaataactggtgtagacaaactttttgtagatatgaccgatgatgaaatttctgatttaagaactgaagataatgaaaagatattgagtttgcaagatgtgtttaatcgatacgggaatactgtgaattatgtaatagaactaaaggaaaactccaatcaaacgaagcttttcgaagatcttgtaaaaaaaataacttggaagataatatcgtagttcaagcatctgatattaaaccgttgcaagacttgagcaaaagttttccaaatatgccaaaactcttattagttaagaatcaaagcgaattagaaaaggcagtcacgtatgacatagtagatatagtttctgctgaaaagagtatgatgacaaaagaaaatgttaaattagttcatggccacaaaaaacttttgaatatttggacaataaactccactagtgaaataaaaaaggcaatcaatcttggtatagataattactttaccaacttcacagcaaaagctttagcattagaaaataaatacagaaaataaaaaagccccttctcatttgcagagtgtagtgaccccaaaaagttagacttttatggagtggagaaatccactccttttttgtatgataagattaactgttagacagctgtttttacagcttctcgaaactgaaccggacttcgccaatttaatttctttttgatgcgtttatggttgtaataatagatatattggtcaatttttgttttcaattcatctaaactccgatagacttctccgtgaaaaatctcttgctttaataaaccaaagaagttttccataggtgagttatctaaacaattccctttacgagacatactctggaagattttatgctgcttcaacatcttgacagcgtatatctgtttttaaggtagtgcagttgccatctttaaataaattacgaatttctttcgttaaataatgttgtttcattggcgtgttggtcaatgtccaagtcacatttcctttaaatgtttgatctggcactctacttggatcaggaatttgtaaaccgacatcgcctaactgtaaatcatagactccattgacaaattgtccgccattcgtatacatgatcgtctgatcctctgatgtgaccattagatgctcattttcagatttatttacttcattttggttattttttttgacttgttcagttaaatcgtctgcttcaaaaggagtatccccatcattcatatttcttttaacgtcacctaccagaggaacctttagctccaccccttgatagccattatcgacattaatcgagtgtctcacattcaatgaccatgtttgtgtatcttcccgtcgcttgtctttcactccaacgttaaatgtttttccatttttattcgtcgtagtgattgtttgctcttttatgctatcttgcaatttggtgatcccaaaatcaaaggttctaggcacataagaaataccaaaatagctatttttgattcctgttttttcatttaaatcactcggcggattgggatcgtacccaccattttctgataaacctaggtttccttgtaacggtgtcgttgcttcagaagggtttgcctgattttgctcagccgcagaagcgtatgtaccacctaataccagcacactactcaacgtaattgcctttaatactgctttactgatcttcatttttttcatcctttctttcgtttattcgcattgctataaacagtatagcggagctcattccacttcttttcttagttattttatgaaaagttgcaaccttttaaaaaaataaaatcggcgctcctctgttttattatgaaattattccgagctttacaaaaaggaatacttttaacaaacaggttgcatctactaaatctcttcctttcagctattaccccaatgaaacgactaaacaatcacactcttaatcagtgagccgtagattcgagcccagtgaacgctcatcttaggatggattttaagcaaatcaagttcgaaggtggaacctcttatgccctcttttaaaagatattctttcgcttaaaaagcttctgctttgtggctaatacagatattcctatcaatcgtaagtacattaaatggccagtaaggtccttttagcaaatgaaagaattactcttgttaaaaattgttcgattcttatttattcttcaatcaattaaatcaatcaattaaaatgatacaaaaaaacctgagatagaatgatgatcattctatctcaggttttttgctatacgacacgtcattccttattgatgaagaacctgccgatggtataaccaattttttttgctgttctttgcctcgaaagatgtccctcttttacaaacacgctgtgaaatcttcaatttgtccttctacgttttttttctctgtttttttaccacatcacaaagacaatgactaagcctagcattcctatataagaaaaggtacttccagtttgtgggagtgttcttggatcatccaggtctggttgggtgggttcttcctcttggtaaaagctcacaaccgcacgattctcatttgttgtcgcatgtccaatcactgtgctccttgaaaagacggggataaaaatgcagagaccgaccaaaaacacgaccactctctttctcatcgaatgcctcctatcgtcggatccccgactagttcccaagtaattgttgcttgatactctcccttgtccacaggtgtattggcaggcaaatgaagtgacacaccggttaatgtctggtcttttacttctccaatttgaatgattgttcttccgtattcatctcttgttcctgatctatctcttgccgcaatcatttgaggggtggttcccaacaggatatcatttttgggaatggaaatacctgtatgaacagattcgatcactttcaactccttcaaagcgatggctgcttctcttaactcctgatttctttcatttataaaagggctcatcgacgcataaaggctccactgggcagtatcactgtaatcactgaccataatcgttggagcagactctccttgcgctggaatattttgtctacggctcgtttttaggacgtcgccaaaatcaaaattgccatgagcaattcccgccaactccagtcgtccaagtccaactgtaaaggatacctcgtacgtcattgaaaaacggtacccattttcttttgtttgtgtcacttgtacaactgctttgccttctttgcctggtaatagtgcatcagaacggatcaaatcaaacgaaagctcttctttttcctgttccgtaagttcttcatggaaattgaaaaattctgtcattctctgaaggatttcttctgttgaactactagctgcaaaagttaatttattcgtcgttaattgattcactcgcaacaattggaagccgcttggtgtcatcatatacagagcctctggccagccaatcgcctctcgaacaggttcttcatttctcgtgacccatgtattggctccattgtaattctgattggctactgcgaacctatttacgcttaatccgatcacatcaccaaagtcaatcggactattgtttaacacattgttccaagcttgtacgacactgcttcttgattggtttactgtaaaaaaaggaagcagcgtttggttggtgtaatcgttgcgataaatcgtataacgtggtcttgatgtaacttgattcggccaagaattgccaaatccttctgatgcaacaagagatggtccgttatcattgatatgaagactgattactccagtgctagcactgattgctgcttctcgtgaaaatatcgagtggccccatatcacttccaccggtacatttatctgagtcgctgcttgtgtttctacatgtacgacggtgattgggacttgcagatttcccaggaaagtggtgttcggttgattcaaaagagtgactttaaagtcctcacctgcgacttcatctccattcagcctgacgtttgtcactaactcattcagtcgttcctcgacaaatttcccacctagtcctatcttttgagggactgcttcggctgtgagcacagtttcgtcagaataaccgctatgttcacttggttgaatcgttttagactcttccgttctttctggaatcgcgcttaattcaggatcaatgttctcttcatccaaccctgaatcaagcaaatctaagtttccctctgattcatcagccgcatgatcttctgcatctacaggttcaaaaaattgatgttcatctgaatcaagagtggaactttggtcttctgccctttgtctctctgacgcatcaacggtttccgcaaataggattgtcgagggaagcaagtgccctgtaacgagtaaacttgctatggtgataaggacatttcttttcatttgatcgcgcctttcccttcaaattaatccagaagaatttagggtgatttatccacctattcctgtagtcggatccgcaaccagctcccaaacaatcgcagtagaatattcagtattgtttgctgtggtattggctggtatacgcaatacaacaccgtcagtatgcccttctccatttgattgtcctaatgctaatgcccaagcacctgacccttgcgcggtatctgctgtggctagcgtttgtgccgctgctccgaggacgatctcattttgattgactattggtgtagcagccgttgcattcacataacgcagcccggataaagtaatcgttgccccaatcaattcatgaccactcgcatctgccaattgattcggctgtgatacttgtaattcccatcctagccgttcacttcctcggcgatcttctgtcgcgacaaaaggcacacgcgagacttcttcaccgtttacccacacatgatcgagccgcgctttttgttcaatcgcacgcgagacattttgaatctgaccaaaatcaaagtttgatacatagttgatccgtaaaagtcccggataaggattggttggttcttcgggagtaacctcatttcctggattctccgggtcaggaacgactgggtttgaagagtcattttccaagattttcacttttccttcagtcgtaatattcgctgcgtcatcataagttgccgcatcccccattttgctatccaatccaagactagctgctaaaagtacaattgataatgttcgtgtcgtttttttcattttctttcctccgttatccttttgaagttcattttacagggtgttccttcatagtttcacaagatcctgctcattcatttcattacgattaagcattttatgctctttaatttgctggatgactccgataagccagtcctttttatatcatgggtcgttttcttctcttttttctccgagtccgccttcaagtccaccacatcaccaaaagaacgaggatcacgccaattccgacaaatatcccatatgacatgtaggatgtcgtccgctctagattgaccgcactttgatttaattgccgggcattcgcattcgtaatggaaaaagattgttcaaagcgatactctttttcatcagctgttacttgcgtctttagaacataattccctgcttcaattggctgatttccagcagggatgccaaagttgaaattagaatttggtgccattcgcaactcgtatgcgtcatatgtatagataggggttccacttccttctctataaatgcttgactgaatagacatgttgcgaacaatcacagcagctctattttgtagatttgcttcaatgtgattccgataattacgctgactcgcggtcacctcatttaaaaacaattcattttcaactgctgacccgcctactcgatttaaaagaatgcctaccgtataggcgacttcatgagtcacagtttgttcactctgctgattctttttttcagtaaaacgaatgcctccaaggatatccccttcccattcttcttgtggtaaggagataatcagtgttgtgagtaccgaagaacctgcaggaatcaggagttcactctcttcaattgcgaccagttgatccattcgatgaatgagagaagcatcatacgcttcttcccctaaataactggggattccattttgattcgtagaagctggatttacggtcacattcacgctgatttcttcttcagaaaggttatacactcgaattgaaacagtgcgttgctttcctggctcgtcaatgatatggtaatagccattctcattcacatttccattctcatctagtggttggattgagaacgtattgacgttttctgcaaaaacttctttttggaagagaccaatagtcaatagcgccaaaactgctatcatgacaaatcgtctaattttttttcttaaattgttgttttccaccacacccctcctcagtctaatcttttgatagtataacttgacggtaaaggctgtcccaaattcatatcgaccttcattatgaataaaaaaggattgaatctaaaaaaagcaagtgcaatcaataatacgcaatgattgctcttgctctttttatatgaaaaatgttaatttaattattaaaaatgatccttctggatgttataagcgggtttactgcatgattcagcggaataacttaaatagtgcctcattcaataaggataggattcccatgtccttattagatgtaaataacctacctcaagcgtatacgtctgattaaaagcacgatcgatttattgcatgatctctcatcaagtaacctaaatgctctttgactgttcagtggtattatcttatctacatcttcgtgtgtcagttgtagtggaaagagtcacaaacaacactgattattgaagcaacccaataagttagattttttgggggtgatcactctggtgtagttattcagtccaattacatcggaaccatatgcttatttttcaagagaaaagatgcgatccagtcaaagatttgttgaggatcggcttcttgttcgagtaagttgaaaaaactttcctgttccaacaaagcgacgagctcggcaatggcagatagatgtttgctgtgatcaattgctgagagggtgaagatgtatttaatcgacgcttttttgttgattatcactggttcttgtaagactgtgatgcctaggcctagctttaacgcgccttcttctggccgtgcgtgaggcaatgctacttgatccatgataatgaaaaaaggtccttctttgcgaacgttttggatgatcgtatcaatataaccacgtgagatcacttgatccttgatcagtggcgttgctgccaaatagaatgcctcttcccaagagcgtacttttatattagtcaaaatgtactgtgggttaagcatatcaatcaacgcaacgggctttctttcctcgcctagggttgctgaataagctggattgacttctcttctggtaaggagcaattgcaattctttcttcaaacttttatcatcttcgattgtcgcatgctttttgataacagccataagttcttccaccccaatcagagaaatagcttcgctgggctgatggtaaacttcttgaatcaattgatttctttcttcattggtcattattggatttaccacataaactggctttttcagtgtataaagactgacattgggtaccgtagtaaagatcaggtcacattcagggcgctcaagcaatagttctttggtctcaatgggtccgataaaaataatgtctggaaagatcatttttaattcattatagatcatggcagagctaccgattccattcggacaaacaatcacaccaattttttgattgacttggtattcatcaaaatcattgatcaaagaagcaaagtggatggttaaaaaagaaacttcatcttctgggattccgcgttcaaaaagatttccgatgggacgcaatgtttcttgaacaatctgatacagatcttcatattcttcaataatttttttatgtaagggattgataattggcaattgaaaaaaacaagcggtaataagctggtcgaaagtgactatataattgattgatgactttttgcttatctttaaaacggatgccggacaatagttcaaagcgtttgatgatgcgctcgaccagttcatgaataatcgaaaaatccgctgatggataagtggtatcccctagcgccatccccagcagccacccacagacatacaattgggctgatttatttgtgataccaaattccattaataattcttttgcaaataaatactctttcatctgaaaaaaagtctggtaattataggtttcataaaaatcttgccactgtttgtttaaacgaggaaggatcatcgtaaacaaataagagaattcattcaagcgattctccactaattctaaagaaaaggtttttagtttttctcttgcgataccctcgacctgtgagaagccatcaattttttcattgaccaagaaataatgatagacaaactcctcctgattatccccaaaatcatgaaacatcatcttcataaaaaaattacgcagattttcttcattcccaatcagcccatagccgttcttccgcgtatacccaatagtgatcattgacagagacagttctttttctaattttttcatatccgccataaaggtagtcttgccaacacgcagcgcagacaagaagtgattcacagaaagatagtctgattcataataaaacaacatcagaaaaatatatttttttcgttcttcactattcatctcatactgggtataaacggcaccgtttaggaaatcattcagaaaaaaagcttttgcctttggtgctaattgaataaaataaggatctgatcgaatcaacggctgtttatttgcttttaatagttcattgatttttctgattgcataatccaattgattttttgacagagaaaagaagcgcattatctcctcttgttccatcaatggtttttgaatcattttctgtatcagctgtaatgtgcgttgatcgatcatgaccctctctcctctctttgttaattcacaaatgtgtcgatttctttgcgcaatcgtgccgcattctttgcaatttctgcttgcgaaccttttgtcaataatgttcctactcccatacattctacaccagcattcaaccattctgtaacatttgtcaaagaaacgccccctgaagataagatcgggacaaacggcaatggtgttttgattgttgagacgatccttggcccatgtaaagaagacgttggaaatgctttgatcatatccgctcctgcttcgagagcttctaaaacctcagagatagaagtacagcctggcatgtagctgatttgatagcgattgcttatctgtgcgactgcttttgaaaaagccggtgagatgatgaattcagcaccatgtaaaatcgcatcccgagcggtttcgctatccaatacggttccagcaccgacaacgatttcgtcttgatagatttctttcagttgcttgatgatttccccggcattgttattcgtataactgatttccaagcaagttataccaccggctttacagccttcaacaatttcaacggctcgttccactgtttcgacccgtacgatcgccatgattttttctttatggatccggttgaggatcacgagcttcttattcatcgaatccctccacttttcgatattccgctaaaacttgatggatctctggatagtcctgttcatctactggcagcaccggcagcttaggatcaccgacaggaattcccatccaacctacgcagtattttaggacactgggtactgtaccgaactttaagatacggcgaaagtcttcaatacttaattgatagtttctagctttctgggtctcaccacttttaaatgcgtgataaatagctaagtcagttgtcgttaagacattggaagttgctgcgactgccccatcagcgccacattccaacgcttccaagatcaaagagtcagaacctactaaaatagaaaaatcgtctcgctcattcaatttgagatagcttttgaggttttctatgtccccgctgctgtctttgatcccaataatagtgggtattttcagcaatgcgttaaagatggtttcattgatcgcaatgccggtattcttaggaatattgtagagaatcaatgggagttttgtctttgcagcaatcattttatagtgttggactacttcttgatccgtaagcttgatcaaataaggagtgatgatggaagccgctgtgactccaatggtttgaaattcattcactaaatcaatgacagcttctgtcgaaatcccacctgctcctgcaaatactggtacccgacctgctgtctcctctacaacgatggttgccaattcgagcttttcagcatgagataaggcataaaactccccattggtccctaggataaataacccatggatccctttcgcaatcaattgattaactagtcttctagtggctgctcgatcgattccctgctcatctaaaggactgaccatggctgtaatgattccttcgatcttcattcttcgacacttctttcttgcatgatagcactccctaagcttcctccaggatgccatgcataataatcatcaatatcaatggcggcttcttgttgcagtaaaatcgacaagctttgtaaaacgatgatttctgccaatatcgagattcgtgggggtttgttcaacggatctccttcattcgtgataccagcaaacaagaaggcatcggaatgtttttgcagccatgagtcgatacctccactcactccgatgacttttattcctaaagctttgagcgtaagaagcgattttttcaattcttctgtttcgccgctattggaaatagcaatcacgacatcccctttttcggcttggccggcagagccgtggatcgtttcagttccatctaaaaaataggtaggagtgcctgtggaagaaagcaaagctgctatatattccgcaacatgacttggcttaccgatgccagtcacatgcacacgccccttctttttttttgcagcaacgatcagttcagctgcatcgatcaactgttgttgattgatctcattcaaataagctgtaagctcatctttggttgtttgcaaaaaataagccaaattcgttgtttccatataaaatcctttctgtcactgatccgttttcactgaatctttgcacactttgagatagttctttttgcgtgcaaagattcagaagttcagttgatgacaaatatcttagcgatcgattactgaccaaacaaacttaatagtttatctaataaaattcccatgacattgtagtcgatatttgggaatgtcgatccctcgatgcctaagctaccatacaccgggtaaagaactgttggtaaaaaggcgagtaacagcccgatgacaaaggatcctgcaatcgctccccgccaaccgccagtagagtttccaaaaacgccggctgttcctccagagaagaaacaaatatgggctgctggaatgatcacgactggaaaattgaaaagcaccatgatcaatactcccaataagccagcgacataagaggataagaaccctacaatgacagccgttggtgcaaatgggaaaacagttggtacatccaatgccggacgagaatttggaatgaatttttccgagattgaaacaaatgccgccgtaatttcagacaagaacatgcgcacaccagtcatcaagatcgacattcccgcagtaaaggtaaatgcctgcacgaaaggaaagaccagccaatgagtcgttcctgctaattcttgagtgacgtctcgccccgcttttaatgcagagatatagaatagcactagcataactgccgcaacgcccatcaagaagtctctaaaaaaggataaccatttcggaaaattgatgtgttccgttgttttatctttgtgtttaccaaatagcatcccaatgtaaccagacaatgcataacccaccatgttaaagtgtccaatggcggtctcatcactgccagtaatgcgccgcataaatggttggcacagctgaggtaacgcagcagagaaaaagccgagtaatgttccgccaattaatatcgctggaatatcagcaaactgatgagcctttaggatcagtgacaacacacaagcgaaaaacaaactatgtcctgtggtaaagaaaatatttttaaatggcgtgattcgagcaatgactaagttcatcaaaaagccgagaatcaatgtacaactggtcacaaatgcaaattctgtttgggctagtgcagtggcagcttctggtgatgcaacgacccctacgatgttgaaccctttttggaataaggtattgaaattctgtagtgcgccagtcatgatcgaaccgccggaactgaatactaagaaaccgatgatggttttaaaggttccagtcaacacttcggtcattgattttttttgggccaataacccaatcattgcaactaaacctaaaagtacggctggcgtactaagaaaactaataattaaatccatgagcgtttctccttcattgatttttagactaatgcggctgcaattttttctttgatttctttcttatcaacgatattgttgattccaatgatagtttgctgcaaatttttttctcttaattcattggcaacatctgtcaaagtaatgatcagatctcccgtaaaaccagagaccgcatctaaagacgcatgttccacctcgattggaaagtcattttcccggatgacctcattcactttgatttttaacatcagacttgagcctacgcctgctcgacaggcaatcagtgctttatgcatagttattctctccttcaaatttttttagaaatgcaattagttcgtttttttcagtcattcgtcctaacaattccagaaagtctttgttgcccagcaactcagccagttcggataacaatgaaatatgggattcattgtctggtgcgctaaggggaaacaaaaatttgacaggatcatttgattcatgaccagaaatgacgggtcgttttaatcgagtgaagcctaatgctaatttctttgcccccttctctatgggtgcatgaggcagcgcaatttgtttcgtaataacaatataaggccctatctcatgataaatagaaaggatggatgaaatgtatttcttttcgatgacaccggcagtcaatagcggctgtgcggatgccttgattgcttcgtcaaaattttctactgagatatccaattggatatagtcttcttttaataattcgcttaacaaagttaaccacctctcgtacaaagaattctcgagtcttcttgtatgcgtttactataagcaatatcactggtaccggcaatagtgattgcgttcatctcttctagaaaaaagcttgaaaaactgaactgtagccaatgaaatttgctgaattttgctgttttatcaacttacagcaactagtctgctctcagtgattgtcattctgttcaacttgtgggtgtcattactagaaaaagcgggctaaatgctcctaaaagatctgctgcaagatgatcgagctactaaataaaacagcaaaaaagcagacatcttacctcaaaagatgcctgcttgatacctgtcataggttagtgagacagattcagctgcttatttccattttaaatttagcagctccatcatttcatgatacgcggtttcgattcgctggcgtttgtcttcgggtactttatccgcatacttccccccaggaagatattcttctgccagtacaacttgaaaatcataggcttcggtagtgccaaactctggatcgtcatatctacgatcagggatcggctctttagagacccatgttggatgcagcttgatatcactcaaaaatgtacgatcaccttcttttgtgagctcgacttctggaatgacccctcgctcggtccaatagttgttgactgtttcgtagcgttgattggatagcaaatttcccattgaatagagaataaattttttctcgccgtctttttcgatgatttctgttggttcagcgacatgtggatgaccgccaaaaatgatgtccgctccgaggtcgatcatttgtcgataaatcttctgctgctcttctgtaggttctaaggaatattctacaccgagttgcggcataacaacggtgatgtcggctacattctctgcctctttgatttcagctgctactttttccatggataaatcttttaaataggtcgtatattcttccggtgccaagctagcttcattgccattgaatccgtaagcataagccagcatcgctactttgatgccattggcttctttgacgaatatcccttgatcatttacattgacaccaatcggctccaatccaatctcctgaaaagcattagcagtcgttttaagcccttcgattccagtatccaaaatatgattatgggctagatcaatcacatcaaaaccagctgctttgatactttctactacattcggaggcgcattaaaggtaggataaccgcctagttctttgttgggattgatggtgccttcaaagtcaccaaaagcaatatcggcagaagcgatcaacggttgcacctgctcaaagtcattgtcaaaatcatagcgtttcccatcaaatgcactcatataaactggtctgtgatagagcatatcgccacttgctgtcagagtaattttcgacgattgagaggccgttgttgtttcttggctggaagtagaaagtgacacttggttatctggggagcttgttgacgaatcagtcccagtacgcatggtgtgaatcagccaataactaacggcaatcgtaacaagcagtaaacttatgctcaatgcccatagaagctgtcttttccgttgttcaatccttcgttgttgcctcattgctgctctccgccttcccaatgtaactttcattatcaacgttcgctcgttcttgtttacattactgtttatgatatttgctttatctacatttcgtttcatgctgtttttctgcttactttctttaataaaacaaacctatatatcatgtatataattaatcatactaaagaatcagttcttttgatagccctttctcataaaaagagcagctaggcatttctgcctaactgctttactcatactcgctagttacctaataaaactggcgttagattcatggataatttttagattttctcttcttgctttactggacagctttgatggcaatcagaacaactgccttttttgaccattcgataaagcacttttcctgcatagccaaagatcactagacttaaaagaatcgttgcaatcatttttcgcctcctactacttctccgactacttgtaatagtggtgaatttttttgttggggtctctttatcagagcaaacagcaacaaaccaagaacaatcaacgctgccaaggttcctactgtcagttgccctccttcaaagaagatatgcccgaattggtaaacaatcagacttgcacaataagccagtccacactggtaactaatagccaaccaagtccacttgctatcccccatttcacgatggatcgcgccgatggccgcaaaacaaggggcacacaataagttaaaaatcaaaaaggagtaggcggctactggggtgtaatcgcctcgcagcacttgccagatctctgtaccggtttcagaaaccccactttggccgtacaaaatcccaaaagtcccgatgacattttcttttgccaccaatcctgtaatggtcgccacggcacctcgccaagtgccccagcctagtggcgcaaaaatcggtgctaacaaacggccgaaaaaggctaagatgctttcttcttcccccactcgatcaaaggtaaagttgtagctagaagtaaaccagataaagatacatgcaacgaagatgatcgttccggcttttttgatgaaggctacggcccgatcaatcgcacttttcaacacggttcctagttgcggcaaatgataggcaggcagctccatgatgaagggtgctgggtcgccggcaaagagagcagtctttttcaatgcgatacctgataaaataatggcccccatcccaatgaaatacgcagaaggtgcgacccatgaactgccgggaaagaacgccccggaaatcagtgcaatgatcggcagctttgcagaacaaggcataaatgtcgtgaccatgaccgtcaaacggcgatctttttcattttcaatagtccggctggccatgaccccaggtacaccacagccagtagcgatcagcatcggaatgaaagactttcctgacaaaccaaacttgcggaacaagcgatccatcacaaaagcgatgcgtgccatgtagccgcaatcttctaataacgccaagcagaaaaagagcacaaaaatttgtggaacaaatccaaggacagccccgacacccgccacgatcccatcttggatcaattcctgcagccattgggctacttgccattggttcatcagctgctgcagaatatccgggactaagctgccaaacaggacatcattgacccagtcggtgcccatcgtaccgatcgattggatggataagaagtagattccccacatgaaaagggcaaaaatcggtagtgccagtaggcggtgggtcaacacacggtcgattttgtcgcttaaggacaagcggtactcttcttccttgactgttgctaaagctaacaattgttgaatgaatccataccgttcgtttactataattgcatcgctttgctcatcaaaaatcatttccgtgattttaatgatttccgctaattctttttcatcgctcggagtcaaagcgacttgttgacgaatcaattcgtcaccttcaaacagcttgacagcaatccagcgtcgtttgctctcgggaatttcagttggcaatagaccaatgatctctgctaaagccgcctctaaacgtgaatcgtagatgacgcttgactgaccatttcctgctcttttctttgcagcatcgatcagcttattcagtccctgttgtttcaaggcactgattcccacaaccggtacgcctaagccataggctagcttctcaaagttgatctggatccctttgcgctttaaaagatcgatcatattgattcccactattgtaggcagacccatttccaacaattgtaaagtgaggtagagattccgctccaagttcgtgccatcaacgatatctaaaaccgcatcgatgggggcttctgccaaataatttctcgagatcacttcttcaggagtataaggagacaatgaatagatacccggcaaatcttggatggtaatttctttggctttacggagctttcctgattttcgttcgactgtcactcccggccagttcccaacggtttgcttggcccccgtcagttggttgaaggtgctagttttgccgctattgggattgccgactaatgcgaattgataggtcattcctctactcctttttcaacaaagacgaaagctgcttcttgttttctcagcgacaattcataccctcttaagcgaatctcgatcggatcacctagtggcgctagtttcacgatatgaatcggcacattcttggtgatccccatatccatcaatcgccgccgcaaagcaccagtcgttgcaatttttaccaccttgccctgctctcctacatgtaattgatctagagaagtcaaaaccgtctgctgttgtctttcggacacgtcaatctgctccatgacgctggcatccaatgcgatccggttgtcccgatgcaagatgatgccgcttttacagtttttttgaaccatgagaatgtcaacgcctacccgaagacccaaatcatttaaatgcgccgtgacgttctttggtgtcgtgatcgcttcgatttgatagactctagaagcctctgtttgcgccattttcatgatttctccctcctcttgtgaacgatttttactagttttctacttaattgagaatgattatcattataatagagcgatttaggactaaagtcaatctgtttcaaaaaggatcttgaatgttcgttcacaattcaaactttttttactcaactccattgcatattctcggatctttttggctataaatcgcgattttctaggaaaaatcagctttttttggctgtataaaaactggctaaacactataaattgtgtatgtaattttcacaagcactagatatagtgtttttccgttgactttctccaagacttatttatactagatttataactactactgactcggaggaaatcattatgaatattaaactattttcaaaaaacaactgtatgcaatgtaaaatggcaaaacgctttttaagcgataatcatatttcttttgaagaaatcaatattgacaaccagcctgaagcaattgagtttttgaaagaacaaggattccaaagcgttccgatcatcacttctgatgcacaaacaatcattggcttccgtccggatcaattacgtcaattggccagctaagcagtaacttaaccaatgtgtttttggaggatttgtcagtcgtcaagacctgcagatccttttttatacgatcaaaacaaggaaagaggttgctttttatgagcttgaaagaaatcaaagatgtaagctattttaaattgaacaatgaaatcaaccgccccgttgatggacagatccctctacacaaagataaagaagccctggcggcttttttcaaagaaaatgttgagccaaatacgatgactttcgattcagtcactgacaaaatcgattacttgattgaacatgactacttagaagaagctttcattcgtaagtatcgtcctgcgtttatcgaagaactttatcagtttctgtcggaacagcattttaccttcaagtccttcatggcagcgtacaaattttattctcaatatgcattgaaaactaatgatggaacagcctatttggaaagctatgaggaccgtgtagcattcaatgccctctattttgcagatggagatgaagaattagctttggctttggctgatgaaatgatctatcagcgttatcagccggcaacaccttcttttttgaatgctggccgcaaacgtcgaggcgaattggtttcttgtttcctgatccagttgaccgacgatatgaacgcaatcggtcgggggatcaattccgcattgcaactttctcgaatcggcggcggcgtgggaatcacgttgtctaacctacgggaagctggtgcgccaatcaaaggctacgaaggcgctgccagtggtgtgatgccggtcatgaaattgttcgaagatagctttagctactccaatcaactcgggcagcggcaaggtgctggtgtcgtttatctcaacgtgttccatccagacatcatcagtttcctatctgccaaaaaagaaaatgcggatgaaaaaatccgggtcaagactctttctcttggtgtgatcgttcctgataaattctatgaattgacccgtaaaaatgaagacatgtatttattcagcccatacagtgtcgaaaaagaatacggtattccgttctcttacatcgacatcacaaaagaatacgacaatttagtcatgaatcctaacattcgtaaaacaaaaatcaaagctcgggaccttgaaaatgaaatttcgaaattgcagcaagaatctggctatccttacatcatcaatattgataccgccaatcgttccaacccaatcgatggcaaaatcattatgagtaacctttgttcagagatcctgcaagttcaagaaccttctgtaatcaacggcaaacaagaatatgaagtgcttggcaccgacattagttgcaatcttggttcaacaaacatcgtcaatttgatggacagtcctgattttggaaaatccgtccgtgccatgactcgcgcattgacttttgttacagatgcttctgacatcgacgttgttccttctattcaaaatggaaatgcgttgaaccatacgattggtttaggtgcaatgggcttgcatacctattttgcgaagaatcaaatggaatatggttctcctgaatcattagaattcacagacttatactttatgttgctcaactactggacacttgtagaaagcaataacatcgccaaagaacggggcgaagtgttccataactttgagaaatcagcttatgcggatggcagctatttcacagactatatcacaggggattaccaaccaaaatcagacaaaatcaaagcgttgttcgacggtgtctttattccttctggagaagattgggccgcattggcagaagcagtcaaaaaagacggcttgtaccaccaaaaccgtttagccgttgcgccaaatggttctatctcttatatcaatgatacaagtgcgagtatccatccaatcacacgaatgatcgaagaacggcaagaaaagaaaattgggaagatttactatcctgcaccttacttgagcaatgatacgattggttactatcgctcagcctatgatatggatatgcgtaaagttatcgatgtttatgcaactgcacaaaaacacgtggatcaaggaatgagtatgaccctcttcatgcgctcagatattccagaagggctctatgaatggaaagaaaccagtaaacagacaacccgtgacttgaacattctgcgtcattatgcgttccataaagggatcaaatcgatttattatgtacggacctttacggatgacgcagaagaaatcggcagcaatcaatgcgaaagctgtgtgatttaatcatgcacgctaagctaagcactgactaagaacaaaaaaactacctgattgaatcaaatgtcttcaccaaagcatgatcgagatggattagagatcctcccgaaaggttgaaggcatttgcgactgacaatcaggtaggctccttttgttcttgtctctggtatcaagactactattggaggaacctaagatgggcaaaacttattatgaagcaatcaactggaatgcgattgaagacatcatcgataaatcaacttgggaaaagctgacagaacaattctggctagatacgcgtattccattatccaatgatttagatgattggcggacactttcagatctagaaaaaacaacggttggttatgtatttggcgggctaacactgctcgatacggttcaatcagaaagcggaatggatcagctgcgtaaagacgtacgcacgccccatgaagaagctgttttgaacaatattcaattcatggaatctgtccatgccaaaagttattcttctatctttagcacattgaatacaaaagccgagatcgatgaaatctttgaatggaccaatacgaatccctatctgcaaaaaaaagcagaacgtatcaatgagatctataagaacgggactccccttgaaaagaaaattgcgagtgtttttctagaaacgtttcttttttattccggtttttatacaccgctctattatttaggcaataataaattggctaacgttgcagagatcattaaactgattattcgtgatgaatcggtacatggaacgtatatcggctacaaattccaattaggtttcaatgagcttcctgaagaagaacaacagcgtttgaaggactggatgtacgatttgttgtatgaattgtatgaaaatgaagaacggtacaccgaagaattgtatgacgcgatcggctggacggaagaagtcaaaaccttcttgcgctacaatgcaaacaaagcattgatgaacttaggccaagatcccctgtttccagatacggccaatgatgtcaatccgatcgtaatgaatggtatctctaccggaaccagcaatcacgatttcttctctcaagtggggaatggctatctattaggaacggtagaagcaatgaaagatgatgactatttcatcggtctaggagattaaaaaaagttgaccttttattagggtcaactttttttcgcgttttgaagccttacagcatcacatttttaaggaagtcgagggtttcatccaaacatttctttgattcttctagcgaataatcaaattggtattcatgattgactgcctcaggaacatctttgtaaaagagagatttaactggcacatctagctcttgaagcttctgatcaaaagcgattccttgatcctggaaagaataggcattgccatccgtgatataggttggcggaaattctttggtcaatttattgactaatgacacttgctgcaattccttactgtttttccaatctttggttcctaataaagaccacgcgactgttttaacaaagaatttcatgaagcgatcatcagaagtttgatgagccatttgcttcaagtcaacaggtccgcaataagaaatgaatccttttatatctcctgatgggatcacttgcgtcatcttcatatctttggcgtaatccgaattggtttggatcgctaagaattgcccagcaatctgtgagccggcagagtctccaccaaaaatgacttttttaaagtctaacattggatattgcgctgcctctttcttgatcgattgataggcttgattgatttgtttgacttgccctgggtattctagactaggagcccactcatagttcaatgaaaccactgccacttgtccgcgatctgctaagtaggtcgcaaattctttggccccttccttatcaccaccgacgtaaccaccaccatgcacccagaaaacaactggtactttcgaagcaccttggggatgatagaggtcaaatgtactacgatcatagtcagaagtataggtcagatcattttttaccgtcacatgaggcaaacttttttgatacgcggtttcatctgtgatcttcacctcgtcattaaacatttttccaatcagataggcccctggacgaggcgacacttgaaaagcaatcagtacgactagtgctagtgttactagaataccgacaagccataaacaaacacgcaaaatttttttcacatacatgctcctttgctcttttttcagcttctttatttaaccactttcgctggaagaattcaatcaaccgaaggaatttatcaaaaaaaagaaacgatagccatctagcagatcgctatcgtttaaaagatcaatgagtcaattagagcggtaaaatcatgaatagtccggctgccaatgctgcaccgataaaaggtccaatgattggtacaaacgcatatccccagtcagatgttcctttatttttgatgggcaaaatttgatgggcgatccgcggacctaaatctcgagctgggttgatggcatatcctgtcggtccgcctaaagaaagaccgatcgccaaaatcaagattccgactacgattgggttcaagccatccgtaaaggtatttgcaccaaatgccaacaagccaaatactaaaacaaacgtaccgatcacttcggtcatcgtattcgcggctaagttacgaacggcaggtccagtggcaaatgtccctaaaatagcgccttgatcttctgtttcatcccataacggcaagtaattgagccaaacaagaattgcaccgacgatcccgcctgctaactgtgctaacatgaaaggtaccgccaatccccaagaaaaattacccgtcattgccattcccaacgttacagcagggttcaaatgggcaggtcccatgaaaccagaggcataaacagcaatcgtcacagctgttgcccagcctgtcgcgatcacgatccagccggaagcttctgctttactctttttaaggttgactgccgcacaaacaccatcccccagtaaaactaaaattgccgttcccagaaattcactaaagatttgtgttgcatcactcatatcattctcctccttttaaggcactcaaatctgattccgcaattacttgatccaattcttcggcatacatttgcttgtctgcagctgtccattcaaaataatccgccattgcatcgatcacaccaactttgatctgatccaacgtatctcgcataaagagaacatgattggttcgtcgcaataaataatccacaggggtcagaaccagttcttcttgcaaggcataattcaatgccgtgctttctttttcgtccagccccgcaaacgtggttttataggtaaggactatcggtaagtttgaaccgtaaagatcggccaagtatcgtgcatcttcaggggaaaaaccggcagcttcggcggttttcgccaattgcgccagttcgtcctcgacattggtcggatcaatttcgccgccagacaccggataacgcgtggaatccactaattcaaactgctgcccttttgcagccagtaattcattgattcgtttgacggcgccttcagccattaaccgataatctgtaatcttgcccccggccagtgtcaacagtccgtcttgagacatttccaagctgctgccccgagaaacttgtgaaggatccacactgctggcttctagacgttcctctgcttgtttgatcgccctttcgacttgcgggcgtttgcggtgatcgtccaaatacgcttctacagtttgcacgatttgatcaaagctttcatccgaaagtttgctcttagctccgccgttgtaatcagaaccgccattagccgtgatcagcgggcgtaaccccgcccagctagcttcaatatcatccagttggatcgcagcttctggaaagcgatggttgatgatctctaaaagataatcgacgtcttcttgcgtaacagtcggatgggaaaaatcgcccgtgtaatccgtatctgtcgtaccaaaatacgtcttgttctccctaggaaccacaaaaaccatccgaccatcattcttgccagtatcaaaataagttggctgaggtactttcagcttttcacgatccaccactaaatggacacctttggttgggcgcatttgcggcggtaagttatcattgctatctaattctcgaacgatatcagaccatggtccagtggtattgatcacaactttcgcatggatggcgaattgttctttcgttaattgatcttctacttgaacaccattgatttttccttgttcatcatgaagcataccgacaactttggctttgctgatcattgcagcaccatcttgatgggcccgtttgatattttcgatcactaaacgggcatcgttgttgcggaaatccagatagactccgcctccggtcaagttctcatgttgcagttgcggttctcgttccaatacttcttctttcgtcaacgtataattggcatatttactatctgttacatttgccagacgatcatacaaatccatggcaatcttgacagaaaaaagattgaaggttgcaccgggctcatcgtagataggtaaaagcatgggatctggtttaggaatatggggagcgatctgttgcacgatcgctcgttccctcactgtatctgccacaacttcgacatcaaatgttttcaaatagcggatgcccccatgaaccagtttcgtcgaacgagaggaggttccttcagcaaaatcctgcatttctaccaaaatcgttttcatgccggcagctgccgtttgcacggcgactccagcaccagtgattccgccaccaatgatcaatacatcataggtcgtattttttgcttctgctagggcgtgttgccgatctttataagaaaaagtcatggcttactcgccttctttcttcactttgaatttaaacatctgagtcgctgccactgcttgtttccatccttcataaaggttctcacgttcatcagctggcatttctggtgtaaagagttgaccatcttctgccattgctttcaattcgtcgaggtctttccagaagccgacggccaagccagctaaataagccgcccccagtgctgtcgtttcaagattggctgcccgttgtacttcaatatctaagatatctgcttggaattgcatcaaaagatcatttttagcagccccgccatccactttcaacaatgggatatcgatccctgaatcttttttcatggtatcgatgacatccttcgattgataagcgacagcctgcaaggtcgcccgcacgaagtcttctttcgttgtcccgcgggtcaagccaaaaactgctccccgagcatcagaatcccaataaggtgcacctaatcccgtaaaggctggtacgacatagacttcattgtcgccagtcgcttttgccgctaattcttcagattgcggagacgtctcgatcatacgtaagccatcccgcaaccattggatcgctgagccggcaacaaaaatactaccttccaatgcgtagtatactttaccattgattccatagccgatcgtggtcaacagatcattgtcggataattgtggttcctctccggtattcataacgataaacgcccctgtaccgtacgtatttttgatcatgcctttttcaaaagccatttgcccaaagagagcagcctgttggtcccctgccatcccagcaatcggtacttcactgccataaaaatgatagctgcgagtatggccgtaaacttcggagttgcttttgacttccggcaacatggatgctggaatatttaacaaatccaaaatttcttgatcccattctaaacgatggatgttataaagcatggtccgactcgcattggagtaatccgtcacatggacttgcccatctgtcagtttccagacaagccacgaatcaatggtaccgaatagtagatccccattctctgctttttcttgtgcaccttccacattatcaagcagccagcggattttcgtagcagagaagtaagcatcgatcactaaccctgtcttttcatggatcatgtctgtatgtccgtcggctttcaattggtcagcaatcggagaagattggcgcgattgccaaacgatcgcattggcgatcggttgaccggtatttttatcccaaacaactgttgtttcccgttggttggtaatcccgattccggcgattgcttcaggtcgaatcccagattcgataaaggctcccgcgataactgattgaacagagttccagatttcattggcattgtgttctacccaaccagattttggaaaatattggggaaattccttttgcgaactaccgacattttgtccgttgcggtcaaaaataattgctcttgagcttgtagttccttgatcgattgccataatatagtttttctctgccatgtttctctctccttttaaatggttgatttattcttttgataccgttttcttacatttatcttactcgaattacctgtagtgatctcgtcaactttttagagattttctaagaaattgacgaaatctggaaaaacgccattagttgaagcgttcgcgaatcatctttttgattttttctcgatcgtaagtcgtccctaactcactgatccgatatgtaggaatcgatgtttcaatcggataattcgtcaagatcagatcatagtcttgttctttagcatagcgctcaacgacgaccccattcaaattttttaagtacagcagccacatataaaagactgcctctttgaaaagtgcatccatattcaacgcgatgcctacccgaaattcccgattgatttggtaatcaatgatcgtcaggacactcaaatatttgaccatggtcatcatatacaatgtattttcttctgatgcttccagcttcatttcttgtacagcagtattcaataaacgttcactgatctggcgaatattacgacttgagagttttgcttctaattgccaaatattttctcgatcaaaaacttcgacatctcctttgaaaaaatacaaacgactatggatctgagaaagatgaaaataacaattggcttcgatttcttgcgggacagccggtcgatacaaatgcaggatatgttccaagatcagcgtatcggtaagtgctgtcggcgtaaatcgggagcgttgcagcatgtactggcgaaaatcttgttcagagaaaacggaaaaggaaagcaagaaaacaaaatggagcatcgcctcttcttcacgaacttccagtgcataatgcccaaaactgcgaaagacaagttcccgcagttgctgatacaatggatctttctcataaaatgccatgttttcccgtagtctttgaaacgattgtccgggcgcttttaaacgatacttcatgatcttcagccacaaactgacccgttgctgtgcttcctcggtaaaggtcagattgagcccacgagcgatcagtcccacaaattttgtatcaatcggtaatggctgactcttgaaagaatttaagtaccaaagcagctgaaaataaaaatagcgaatctgagcttcttcccccatgagtttcccctgccaaatctctaatccgaattctgccaacacttgattcaattctttgattttgcgaaacagggaggattcactaatcattaatttttgcgctaacggaatcgtggcgatttcttgattgatcaatacatgttccagcacttgaaatttgatcgacgagtggtagaacacatattcaatctgattcaacgagaactctgggctcgtttctagaactaatgatgaaccttgataaaaaagatggcattgatcagaataaggagctaaatatagaaataactcatcaacatatttttctaaggatggtttgctgatcctaaggtaagcagccatctcatgaagctctagttcacctccaactagaagcagctttttcagtagctgtaattgcttggcttcttttttttctaataattgttcaaatttcatttgcagcacttcctaaagcaatcgcattggacagttcaaagacatcagtaaaatgaggatgaaaaaagaaatctttttgcgctaactctgacaatgtgctctccttttcaatggcaaatgccagcaggttgattttttctaagagattgtactttgacagtaactgagcgcccaatacttgcccgcttgtcttggcaatgatcagtttcccgtggatcggtgtgtcatctactaatgaagctttagcggtaaattttttgacggtaatttcttgttcataaaagaagcgatctgattcagtcattcctgtactagccagataccagccaaacagatgggttcccactgtccgtaagccgccgcgaaaaggttcttttttctcttgcaaattatgcgcagcagcgattccggaacgaactgcattgtttactaatggcatataagccgtatcccgtgtaattggactgtagatctgaatcaagtcaccgacagcaaaaatacccttttcggaagtttccaaataagcatccgtccaaatcgtatgatcactgtgcaagcgcagctgctgaaatgctgggtgcggccgcggtcggacattgacggtcgtcaatgcaagcgcgctgagcaatgtccgattggcggtctccactcggaagcctgtttccgtggattcaatggcaatggtaggttctgccagataaagctgcagattttttatttgtgctaattcatctaaaaaaggagccagaaacgattgatcaaaatatttgaataaaggatacgtcattgattccactagttggacttgttttcctagcgtcgttaatgtgttggctgcttccatacctgcttgtccagccccaacgatcgtaatcgtttctgcctgatctaattcctgaataaattgcttggcagcgccgtaatctttataggtcaatgcggcttcattcatcggtaagagaatttctgattcttgtgcagatcctgctgctaagatcaaccgatcataagcgattctgcgctgatctgtttgaacgaaatggttcttaggatcaagtttcaacattgtttcttgcaatgctacttgaatgtccaactgctcaagctgttccttggagcaaaagaatgcgtcttgcaacgaaggaatcttgccttctaaatacaggagcatcccgctgggaataaacccgatatgggcttttttttcaatcaatacgatttcagattctggatagattttgcgtgcttcgatggcgcagctgatccctccgaatgaaccgccgatgatcacgattttcatacactcacctcttagtctaagcttaaatgaaacgctctcatttgacgagcaaaatgctgtcagtaacgaaaaaaagctacatacaagtttgctttatgctaaactgatgaaaaaagcgaggtggaagctgtggtctttttctatcaatttttactgggactgatctgtagtgcatttgtagcaggatccgcttttattttgcagtggttgtctttatccggtgctttagcagctgccttaagtgggacgatcatcattgctttgggaccttggttcagtatctttttagttggtttcttttttgccagctctgggatcatcaatcacttaaagaaaaaaaactcagccgatgatctggtgatcaaaggtgcgcgccgcgaagccatccaagtgctggctaatttatcgcctagtttattggcattgatcggttacgcctctttcaacaatgagaattatctctgggcatttattgtcgggatcgctagctgtaccgccgacacttggggatcagagatcggtgttttgagcaaaaaggcaccccgaaatctcttaacgggaaaaaaattacctgcgggtctttctggcggtgtcagcctcctaggtaccattgcttcttttgcgggcagcggcggtatcgttttacttctggcgatctgtctctggctcagcggccaaccgctctctttgacagcattgatttgggtactcttgttaggatttagcggtagtataatcgatagtttattgggagcaacgattcaagtacgttaccaatgcacggtttgtcatcaatttaccgaacaaaaaagccatcaccagcagccaacgaaaaaagtgcatggctatgctttgatcacaaatgaagcagtcaactttcttagcaatctagcgattgtcgggatcgcatgtttctttcctaactaaaaaagtactgccaaaggtgtgacctttggcagtacttttttaactaacatcaaccaaccgcagcttagtgatatttttataaactgataattcttcgataacatcagagaaactcagcccccacggtaagttgatcgtataaatattggtatagatccgatagtcttccatgaacttcacatcaaagttgacatcttcgatcacgatttttcgatcaagaaaatactctgtcaaaaattcctttgtttccgcacgatgaatgtattgaatctccaattttttggctgtcgggactcgcacaattcgcttgatcaccgtcagtgcaaaaaagatcccggcaaaactagtaatcgaaatcgcataaaatcccatgccgatcgcaatccctaagccagcaatcgcccataatgaagcagctgtcgtcaatccagttaccgagcgttttgtcacgataatcgtcccggcacccaaaaaaccaaccccacttaccacttgtgcgatcaatcgagcttcatctgaacgaatgacccctgcgagatctggatgattcaacgcatcacgcatcgccccactagcgatctctacttggatcaatgcaatgacacatgcccccatacagactaaaatatgggtccgtaatcccgctggccgacttttgtactgtcgctcaaaaccgatagcgcctcccatgaccattgctaaaacgagtctaagaataatttctggaatcgataagaccatatcaaccattgaaacaccccttttcaactataccatctatttttaaaaatgaaaaaaggaaggtccaaattccgcaccccatctttaagctgtattccatgaaaaataaaaaaaccgaagaatcatcgaaaataccaacttttcatccgactggatgaaatggggaagtagctggtttttccgatgttcattcggattttgtcgattagattggacgctctgccaactaattgatgttagagattggctgccgctgcttcatccacgatgactgtgacatctggatgattttgcaaagcagatgcaggcagatccgtcgttaccggaccttcaatcatcccttggattgcgtccgctttagctggtccaaaggccatcaaaataatttttttacctttcaaaattgaaccgatgcccattgagattgcagtagtgggtacatcttctaccttgtcaaaatagcgtttgttggcattgatcgttgattcagtcaaatcaacgactgatgttgtgccatcaaaagatgccccaggttcattgaagccaatgtgaccgttctgaccaattcctaagatttggatgtcaactggatgttccgcgatcacttcatcgtatcgtttgcattccgcttgcaaatcttcggcttttccattcggtacaaaggtttccttgaatggttttttgtcaaataaatgagcattcataaagtggcgataactttgatcatcttcgccgccaagtccgacatattcatctaaattaacagaagtcatgtttgaaaaatcgacatcgctagctgtcatctctgcatacaatgtttctggcgtactgcctgtcgccaatccaagaactttagcgccgttttcaacgccttgctgaatcaattcaaatgcctttttcccaccttcagctgcatctttcacgcgaataatttccatgatacgctcctcatttcgttttggtatagtccaatgataccacactctcatttttttgacaagaattagtctagaccataacaaaaaaacagctgcatatttcatgcaactgtttttgctgattaccagtttgtgtaaacgtcgattccgctgtgaccaacgcctgtatcatagactttgtaggcacccaaagaagattgccctgttgagcctttggcttgattgtcactagctacaacgatataaccatctgcatcacggatcgttccgtcagcggcaacatgtcggccaggaatatttaagccgcccccagctaatactttttgtgaataataagattctctgacaccattatagtaattgataccgtccactggattcaagactcctgaaccagtacttggtgtacttgcagcgctagtgctagcagcgtttgattgtgtagctgccggcgctgtttcagtttgcgcttgcgctgtttctgtcgtttcttgcgcgcgtgtcatcggttgtgcatcactaaaaatcagcaatgtttcgccatcaaaaatcaaattagggtcttgaatggattcattcaatgctaaaaggtcatccactgtcgtaccatattcagttgctaatcctgacagtgtgtctcctggagcaaccacatgggtttgttcctctgcagatgcaacagtgcctccgataaataaacctagtcctgcaacagctgtgaatacaaattttttcaaatgaaaaaacctctctttttgtgtatttgtacctctccccaggcacaaataaaagattaacattacaatattgcaaaatgatttcaattctattttcttctatcacaattcctcgacagaaaattacagctatattttcatgtaaataatcaaaagcttacaatagtgttatctttttcaataaattttttaagctagtccgtgttatagtcgtctcagcaaaaaagaaatgagggttaattatgaaaaaaatgatgcttgctcttcttgtagtcgcacttggtgtaggaggctattttagttataaatactattctgagacctatcaaggagtcactgcctatgcacgcacaccaaaagaaacacctgaaaggaaacaaacagtagacggttcaggaaaaaaaatcgaaggctattcttcttataaatatacgtttgaatttgttaaagaaaatggcgaaagacaagaaatgacctatgaattgtctggtgaagatatccagccttatgctcctaacacactagttaaagcagagatcagtcaaaaacgtatcatctccggaccgaatgaggtcgctgaaaaagatgtgccagctgatgtattaaaaaaattaaatgcacaaaaataacatttttcattgataaaattgatttttttcaaaaaccaaaaacttctgaactcaagagtaactgtcttctccactctgctttcaggagtttttttatttatacattgttttaataataatattcaacccctcttataaccttattgtgacggggtttatcaaggtgcattcctccgtgacagaaaatcaccgcaattttcctcagtctgtaaaccaagatttcatttcttaagcaaaaacaatcatgcctaatgctcgaatcattgagataacaaatcctactgttgacctctgaataaaaatttgctaaattattttctgccttttggtaattttttttttaggagtgtgaacatgccttttgttgtatattttttctttattaatcatttatatcccttttcccacagctcttttgttctttcaacagcttgccgaacaacatgctaccatcacggctttaaacaaactattattacttttttgtgtcctactcgattattacatcagctatcatctactaaaaagatgccaagtaaaagcgagtagttatcttatcttgattctcatgaatcttggtgaattactcgtacatatctacctttaccagcgttacggaactgtcaatttaacgattatcttactttttcaactctttctattgttctgtatgtttgtttttccttgcttcaaaaaatttagatgttacatatttgaataaacaaaggtttattgattacttgatgagtagtgaagaaacttttagttccagtagtttcttcacttttttgttttaacagttatttgaaaaaaatagaaccatccaattgtaagaaaactcgaaaaaagagttcgataacttgtgggactgaattatcttttactaacaggcctaaagccctatatatttttagaaagttataatttaaactaatctaaaaaggatgtgtgaatatgttaaaagtattaatcttttgcatagccgtagctataatcattgccctgtattcgaataaaaatcgctcgaagaaatagaagttctttctatttcttttttatttcgtcggatagtgaaattatttatttcgactttctttgacattattttttcacattgaaaataaagtatgatatgctgttcaaaaggagtgagcactttgaaaagaaaaactagtttctacctttacctgctagccgcttgtgtaaactttatagcagcttttttatttttagcttcaattggtgccattccaaaaattgcagggcttttattttttgcgagcttttgtgtccacctaatacgagcaataaaacttaaaaactctgaaaagcaaaactgattctgatttcatctcgttagttgcctgatttggtgaataactgattaagtatcaattttttttgatattatttatttatcatggtattctttttatagaggtgattagatgaaaaagaatagtgtttggttaaaaccttggaaaattatgttgattgttctcgctttttttgctggttcctttattgcaaaaatggtcttttctttattttttgtacacatgtaataactttgagccgcccataatccttactaaaagagcgatttcttttagtaaggacgttatttattcctacagttcctagtgtgtggaaagaagaatgaaagcacgaagatatggtatagagatacttgtatctctataccatatcttctagaatgtgcgttgaacgtatggaataataaatacggaacaaaacactttcatcataattatatttttacttttgacagcgaatctattttcgttgaacccatgaaaatattttgctaaaaaaagaaagctcttagaagctccaacttctaaaagccctaacctcatttctgagacagtacaaatatattatatcaaagaatcgaggaaataaaaatggcaaaaagagttagaggcgaagatggtaaattgtataaggtaaaaaaacccttttacaaaaaggtatggttctggattttagtggtaattctagttgctgcagttggcggatctcttgggggtaattctaaagataaaaactctgctgagaaaacatctaccagctcaaaagaagcaacttcgacatcagataaaacatcagaaaaagcttcatcagaaagccaagctccaaaagaagagagcaaaagcgctgatgaacaatatcaagctattctagacgaatacactcaaaaaattaaagaagcagcaccgaagttagttgatgaatacaatgctgaatatcctaataatcaaaacggagtagaaggtttagcagaattgtcaaacgacaaaataagtgagttggctgaaatttccaatgaaggaatacaggaaatggcaaatgttcatttgactagcggatctgggaaatatgaagattacgaagattgggctacgaaattgaccgatgtctatatggaacaagcagaattaattactgatgcatatatgacttctgcacaataaaaaaacacgccccaccgaccaaagcgagagcgtgctaaaaccaaataaacctaatgcttatttgctatacccaattataccaaattgaaaggagtgatgccactcgttcgacatgctggcggacaagaaaggacgataatatatttatggcgaaaataaagaaatataaaaagaagaatggtgaaattgcctataaatttcatgtttaccttggtaaagacccattaactggtaaagaaataaaaactaattgtagtggttttaaaacaagacaagcggcaaatcttgctttatctcgattgcttctaaaatcaaaaagcgctgattttatttttgatagtaaccttcactttgaaaaagtagcagaaatgtggttagaacagtataagaatactgtgaaagcaagtacacttactgctcaaaaatttgctctaaagaagcatatcatacctcatttcggaaaaattccgatcaacaagataactatcccttattgtcagtctaaagtaaatcattggttcagctattacaaaaagttcaataatttgattatgattacttctcaaatctttcagtatgctattagtgtacgcttgcttactaataacccaatgaatggtgtaattcgacccaaaagacaaatggacattgatcaagaggattatgcagcgccctactacagccaaaaacaattgattacttttctagataaagcaaaaaaacagttgcctttttctgaattcctgatgtttagaattctagcatttaccggacttaggaaaggtgagctacatgccttacgttggaaagatataagttttggtcgaggaaccttgtctgttaaacagacgcttgctactgctgatggttggaaattaatttttcaaacccctaagacaagaaaaagtgtcagagagttatctttagatgatgagacactcaaacttttgaaacgttggaaattacagcaaaaagagcttttcttcaaactagggataaaacatgataatgaagaacaattactttttacctcagaagaaaacaaagttttatatcttgattttttaaatcatcgactaacgaaaattcttaaagataataacttagaatatatgacagttcatggatttcgtcacactcattgcagtctcctacttgaatctggcgtacctatcaaagaagttcaagagcgcatggggcatacagatataaaaacaacaatgaatgtatatgctcatgtaactgataaaaagcgggaagagacaggtaatcgctttgcacaattcatgacgaactaagtttaaataatatcgcaacaagaaacgcaacatgcgcaaaaaaagagatgtctccagtgaaggaaaacatctctaaatcgttgataaaccaacgttctaaccttgttagaattattccgcagcgttcgcgtctttgagaccgtattgagagctggattgctctctagtgatatctaataaacagaaaacagtgtaaatacgggattcttgaggaatttaaaaatctaatgcaacccagtaaaatttgattgagaaggtcaaaagtatggtcaaaaaatactcgccagtatattatacttttcatatgagttaagatgttttatccgtttttgtaaaacctgattcatttactcagattttatatacgctttaaaagccattaatatcaaagagtattacctaacttgcactgtaaaatttcaactgttttcaaataatattaaatccataatatcgatttaacgagaaaaccatgcgaattgaaacgattttgtcatgtacaatttgctaactttgaaattgatgacttttcgatcagattaagtatcacagaatagcattcctttaactgaactaatcattttcataataaagaagtccccttgacatttctgtaacttggaacccctctatttctcggcctatttttccaccgacgtagttttcacgattttctagaagctcttcaatggttacaacaattgggaaagttttgagatacttttccctatcaggtgaccaaatatcaataacatcagcaattaatagattaaaaaagaatataagtgttgcctgttgtttgtaatcaatccatttagtagttttaacccatcttttattattcttgtcatctttttttacttgtaaatatgttaatgaatcaccatgtactgataaaatttcattcgttcctcttgtaccaccataagagaacccattttctttttgcgttatttgtagcccatgcttgtaagagttataatcctgtctgttatccagatatgttaccgcaaattgaatataccttttaaaacgctctactatttctttttcagtcaaatttgtcttatcaataatctccgctgggacactcttacttccataaaatacagcagtaataatttcatcatcggtaaagtcagataaattaaaaatattatagacttgctttttcaatttctgtatgttgttattatattttgttaaggtcatgtccgctaaatctaaccaaggacatcctctcatagagcaatgtgccatgtacaaacgtaaaaaagattccaaacaatggaaaactgttaccgccaattctgtttttgcatattttaaaatttcttcttcttcaaaagatctttcatattctaaaatgcctactttcatatttgaccctttacagtaagattccgaggactcaatcattttgagtaaagaatctaattttattgaataataatctttgttgtaattcttgtaaaattcatcattgagttcttcaaactgctcagaagctagattgaagaaaggattgttactcttctttgcttttttagacacttcttttcacgcccctatacatatcatcaataacaaacgtttgctttgttaaattttcccttattatatcaataattccaaatcatggaatctattagtccattcatacgccacaaacgtgatcattgtgcctgtcaaggtgattgactaccacaaattgtcactaaaagctacgaatcaaaataggatcaacaaaggtatcaacaataagaatatgcttcacaaacttagatgtgaaatgtcttattggtataaagcaaatattaatactaaaaacctatgaagctttacgagctttcttaagacctggttagcccaaccattttttcaaatagctttacaatcctttaatagcaaagttttaaagagaatgaaacacgaaaaactttattgactttcaaattatttgaaagcaatggtgtcaatttgttaaacaaaaatatgcgagccgaaatattgtttatgctataaatttttttcagcatctcttatttttctctgaatatttttttgatgatttcttatttgaaaagccatgaggttgcaagtcattggggataatatatcaaagattttctgggattttcgagcatatgtaataaaagttccaaattccctttgcttatagtgatacttaatatcagtgcgttctccaagttgatgataattttgatataatttacgtttatatgttaaacgcattttgtcaccaatatgtcgtttctgtctggagacaatttctccttttttaattaatttatatgcagttctataaaacttagtaatacttttttccctcatcttcacatttgttccatcaaatacaaaacctaaatagtctagcttagtcatcgtatgcgcatttactcttctcaatactttaccatcaaaatacattatattagttttttctttttgaatagacattttagttttatcgaaaatattattttctatttcttgccttaaactatcgaataattcttcacttatgtcaggcaaaatgataataaaatcatctgaatatcttcgataaattccgccataattatttactaaactggaaatagattcatctatttccagcatatatatatttgaatatatcgcacttattgccgtcccttgagggattcctttttcatcattatttgttctaacaactatttttccatcactaaaataatgacttttcatttttttgaaacgcctaaagtcagcaaaactagcaaaataagaattttttctactagcataaatttccttatctggagcaacgaaatagtttatatcttccttgtgaatgtacgaatattttgtcaaacttttataaatcttaaattgatgatctggcattctattatcacagtataaacgattaatcattcgtttaagatattcatgatctaagttatcaaaaaagcctgtgtaatctcctacgtaaacaaaagaattaggatgctctgctataaaattaattacttccgctgcgaaatgaacattatttttaccatgtttgttagtcctatatgctaaaacagaactatcaaaatttttttcgcttacatagatattatacaattcatttaactgtagtccataatgcttatatatataattatctatatgagatgcgtacataattggtctatttttttctttgacagggactttccgtccatttctacttttattttcattttcaggatcatcttttaagtctctaaatttttcaatattgatttcattaaaaatcaaaggtaagaaactatgtgtaggatttttttcaaactcatacacatacttttctacctttgaattaaaactagtgattttgtcaaaatgaagatatttttttgttgaatatttataaacatctttattcattttgagtccctcggtcaactaattttattggagcaacaacagtaaatttagtcccgctactatataatttactttgcacactgcctaaggcgcgacccctaggctctacttctgccaaataaggctattaccgcatctgtaatatggcggggtgagaaattctcacaaaatacaaatagtatataatataactaagaaagtttctccaacagattattactcttggaggtgcgaaatggttcttctgacagtcttggttaccatacttagtatgcagagcttaatattaatattaagattaagctctgtatacgtcaggcaaattacttctgttgaagtcaaatcactttactttgttatacaaatttcctaatactcaacaatatgattgctagtattagctagttaattatagcacaatgactacaatagaaaaacagcattttaccaaataatctgatgtagctctgggacagacttctgtggcattgactcacagcgataccaataccagcataacgagaccctacgtaaataaacaaagcgtcattcaaataccaatcggtgaaattgcctatcgtaaattgtctcaaaaagatataagccggaatggtgtcaactcaaaaaaaacatttcgcaaaacgaattgctaaattccctaaattactgatgtaaagcttacaattgttttttgctttcaattcatataatcgttactttaaccctatgaaagtatccgttctttctcgtaacacatttaaatcatcatgacgaacttctaatctgctaacttggtaatcaaacataaataatcccgcttgattatttataatttctagtggaaggtattcaacatctctatgggctaaaatagagcgtatcaacacgttctttataaactcgtcagtaatcagaattttgtgattgataatttcatatacaccaggcttgctccgtaatagaaatccccaatcaaccaaggaacctaacaccgtcaataaacctttattcactgtctcagtcattccataagtgctacgaacttcttccataatcgtttttgattgaaaagtatcctgcatacgtagatacttcccaattatatttatggtgtctgaaaaaaatgaaaaagaataaagcagcatcaaaacttgcaatgtttttttctcatcgtaatttgaaatagcatattgttttagtactttctcttgaaaatcagaaagtggtttttgtccgttcccccatacgttcattaaattgtttagagcttttctgcgaaacgtatcccctttaattattttggcaaaggtctcatctaatatttgatatgcgtctgtaggtgaatatttcaccattacttcagcagctttgtccaactcttcaaatgtcattacacgaaataatcccaccatttttttcatctatcgaccatccttttttataacttttacaaaaggtacaattatttcttccatgtgcattcctccatgggtcataattatatctccctcaggtacaaatgcaaatttttccttggcaattaacggaaaatagccttcattgggcaaagttatactctcccattctttggttgattcagtatatgagtcatgtatatttgatctaagcagtcctgaatcatatatccgagcacgttgacctttactcatagcaagaacaccttcttgaattcgaccaataccagttgcctccacatttccatgatcagatgtaatatatacatcgtaatctaaatcaatcatgtcacgtaacatcaactctaagaatcccttctcaagccaaattcgtagttctgattgaactgtctccagaccttgcttggcaccatgcataaatccatccacaacatcgatgacacacccatagatatcggtacccacgtatctgaactcaagaacagtatcttgatagtttgtgtgccctagccccttctgatacttgattgaattttcgatgaatcctttttctttccaaaattcacgccaatgaattgactccgaggaagttctggtaattgtttctgggaactcactaggtctttttccagaaaaaattgcttgtcttgaaacagaggtaatagttggaatcatggccatagttgcctgggttcggaaatcaaagcttttattaactagccatttttcgataacactccattgagtaaagctcattccatccataacaatcaaagctaattttctatttgaaataccttgcattctgtataaataattcaaaatttgattaacataatttggcttttttgccggaggtagggaaagatttctgtcataatctctttttaaatactcttgaaattttttattggcatcatcgactaatagttcgaattccttatccgttctacgatataagcgatgttcaccaatcaatctagcaatctcgctccattcacgcaagaccggagcttttttattaaatagcgtaagatcttcgacataaggatcaagtatcattgaaatgtgttcatcagcttcatggtaaatcacacgttctataaatttcattgaagaaacataattttgtcttgttgttaaactttgctgggcattgtataattgctcccagttttcaatgcctagctttttcacagctttacagtccaagaagggaaatatatcagtaattccaataaattcacgaaatgctttttggtacacgtcccaaggaacctcttgaaaatcagtatctaccaagcgaataagtagtattccatcaaattttctaccgaatttagtttcgtatgtataacgaaaatgaactggatccccataagttattacagaaacatctaactcagacaattcgaccttaacattatctatcatcagtaatccatcgtcatctcttacaagataaatctttttctgcgggaacctgtctgtaatctcgtttatccagttcattttcatcacttcctctatgtgtagaatctatcaagtttctttataattagtatttattacatttctgttcgcattaaagcattatcatagtacatcaagagcttatcgtcttcttggattactttttctggtagacgctcacccactgttacgatagtttgatattctttttctgtccacgccttcttaaaaccaacacggattgcttctgtacggaatacttttaatttcttcttgctattattgatttcatcaagataatggccaaattcacgtagtaagctcttctctcgcagtttttccaagtcggcttgttgattaggatttggcacataccaacgatttttcgctttttctcttaataaaacgtcatctctttctaagccacgcaaatcatgataattttttgtcagataggtactaatttgatttggtactgcctcatctccatcatagtataaaaagttttgtgctaataactcatcgagctcaggtaattcttcatactttgcaatatgctgaatctctttcataaactgcggatgaatatcttgtcgagattgtggttttttcattaattgttgacgaatccattcaatagcactattttcatcagatacaaatagcgacaattgagcaaactcttttgcaagaattcgttttttatcatattctgccacttgagagtctaagaaagccatgccatcgcgcatcggataacgactagcaatacctgattgaaagtcagcagaagaaattgggactggtagaccttgttgaacatgataggcaaccattctatcaaatagaatacgtggtgttcgctctgatatgattaccgcatcacctttgtctcccataaatactggaagatttgataagtgttgtgtaacaaacgtccaagctgattccacattattacgttgtgccttcattttgtcaatattctcttcagtaggcttataagcagaaattactaagtcctgcttaacagccgttgtcgtcgtgaccgctttaaaacttccttgttttttatcaagtgcagagacatctgcaattataaagcctgccttttgaatcgagtcttgtattgcattccacacactagatttagaattgctaaattcaactgtaatccaatgattaggttttaaaaccttaaaataatttctaaaagactcttccataagttgcttatattcaaagagacctttattttgtgaatcatttataatcgcttctgaagaactatttgtgaacacttttaaccatgattcccataaaaaatttaactctgagtaatcaatattctctccaaatgggggatctgtaaaaatgtaatccactgagttctcttgtaactcatttgtaattgcagagctgacaaatacaattgatgaccgttgtttcacaatcaatgctttagctatatcctttacttttcctttaaaaacattatatacattagtctctgccattaaggaagggaggtagtatgtcccgctaagcatcccgttgcctctatttcccatattataacgtaccagttttgagataagactatatacgatggattgaaaacacaaatatgctggtcttttaagactttcaggcagtttagaaattcggtccagtaaatcacttgctacaatcaagtttctttttgtgtaaaactgatgtgtatattcaataccatttctcttcactcgttcaatctcatcacccttaggtaacttgaatgctggaaaccatttattaatattatatttatcaatcttctctaaaagttctttatctttattgcctatttttttaattcctttatttctaccaaatccataactaattaatacaggtttttgtttaagaactttaagtttttttccaaccacagcatcaaaatactcagacattactttatcagatttttgtttgtttaataacatgccacagtttggacatgaaaaatcagaatgcaatttattttcttcaatatcgaaagcctcttcataataaataaattccgtcaagcaatttgggcaactaaatacatcgctccatacagtgtaattaatatcatattcaacattatttacttcagttttataaacccatcctaaatctttctttgaatcagccaataattttgttagctcactaaccagcaattcggaatcaaccgaactattatatacctcagaaataacacttcccactggagctaaatcagaaagaaaggcatgtctaacaccaatatcattgtctgtaatatccggcttaatttcaagaagttcttttttgttattcatcaatgaagaagcaacacctgtcattcctgtcccactaaaagcatcatacactatatcgccaggtttcgtataatgaagcaaataactcattattgctttgtacggaaccttggtatgataagtatgtgcgttatagattggagtatttttaccaaagctaatatccacggcaagaggttcttttgaatactcttcaacgtcctctgttttccattcattgataaacctattaataaatgggttaggacatacagtataaaaaggcggatcagacagctcaataatatcctcatcattgcctattggaaaaccttcaattttcctcaactcaggaagtttttttctcagttcctcccggaaatactctcgacgagcatcatcattttcaaattccatcccgagaactgtcactcttttattttccctttgttcagaatcaaaagacaattgttcattttctaatgacatctactcacctcttaaacataattctaactttatttttctctttgccttcagttagctctgcaatcaattgacggatacgtccttctaattcattaactgacattggactaccgtctcccattgctttaaccagctccgcttcagttatttcaaccttctcaaagcctttaaacaaattatttatggtattcaagaattggggactaatcggaaatgttaattcttttgtagcaatgaattgattaatttctactttttcttcattattcaagagttcccgattctcaacaatgtctccctgttgtaagctacttacaagaatctccatccaattttcataaattccagttaacttttctttaccattagatacaaccaatttagaattccgatcagtttttccaatttcgaaattacaatgagtacatgtcggatattgttctagttcagcttttgttagtgaaaaacaagctcttgtagcacgtagctctcggacccaatcaataagctgttgacccggaagaatgtcgatattggcctttagtgtagctaatacatctgcctcaactgaattaagtagcccatcacgattaatttcctctttacttgttaatcgagatttctgatgaatatcataatattcatctatatagtgctctttaatttctttcaagtcatccatttgcgacttgaatccagcacctttcttcacggcttcaacgacagcattaatcgcttcttgggcattctttgtccaatcactctcaaggccatagttgtaagtagcctgtgtaatgtatgtcactagtgtaccgacttcgtcaacgtctttcttcatctgttcaattgaatcaattaatttcttgttttcttcttgttctgagatttcagtaacgctagccgaaaagtttttcattttagcaacggtattataccgttggactttttcacaaaagtctttataagaagtgagtctcataattgtatcttgtcgagtatttgcgtccataacttctgtgccgccaatagaaaaacctttcttgaccatctcaatagtatttaaggtatgactcacttcttcaattgacttgctgctaaggcgcctaatatatccttctagaatcttctcatcaaagtttggggcgtattcatcaaatagatttagtactgcattgatttcattaattggaagaccagatggctttttgatatagtcgaaattagacaatatctcgatattttcggcagcaaactctcgatagttcattgctgtatagttcgttccagctacgcttatctctaattttcctgcataaagaagcgcaccaatcacgacaactactaattcgggctccaatttaaactcttttgaaagacgtctatctcctgtaccacgtaaggcatcttgatcatatatttccttattattaaccaccttgccgttacctttttcttctagcatttccaaaatccatcgtgaaaagccagaactagaaatggattcggcagttactttcccagcactatcttccataaccaagccgttcagtatggcctccccagtttttgttgaacgtccatttaagaattgcaaggcatcacttgcggaagttttgatattatcatttgttagatatcctggcttatattctttaaaggttggataatctgggtatttctcttgaaaggcatcattcaagaactctgcagaagcatagttgaccattgctttcaaagtatcttcttgtggaaggaacattccaaaatcagaaagatatccttctttacctttataaaccaccttgaatacatctacaaaatgttcgaacagccatttattcaattgcttatagtagctatcatacttagctttaaataagggtttttgtgcttgtgttgtttcaatgtactgctcttttgccgcagcatattttcgtaatgtcttttcaaagtaatcgtcttctaaattaagtttgaagaagacttcatccgagcgcttctcatctttatagtttacggtattaaatggtcgtaacatgtaaatgtaaaaatctctctctggttgcgctgtagatcgctcattgggagaacccaagaaaagatatccttttcgcattactcggcgttgttcccaaggaagctcatatgaccaaatcttataaccagaaatataagtaaggtcatccaaagcaatcgcattttgtaataaatcaaaatagtagcggtccattgtgtccgcttcaatgatttcagcacgatctgcaatcagactatctacatcaatatcttttttcaaatctagataatattgtgcattgacttcatttactgaaatatattgataactgactgtttccataattgtcttaatagccacatctatatttgttttcaaaaatcccgcaggatcaggatcttcaagcagcatatccatctgaccaggaattgttagaaaaaggtcatctttcaattcatcagaagtcatccctaccttagaatagatatcatcagtagttagacgattcaatgccatagcattcactatacgaatagacattttttgatagcgtctttttgttgaaggaaaggcactattgattctatccttcaaaattgatactttatccatcacttctcgaacttcaggaattgtcttgtaagatgggtcttcctcaatgtatgtccaataactatcataggaaactaatcctggatcatctatcggtacttcgttattaataatctttttcatctcattggtgatggttttcaatgctatccgtttttcaatattatgaacattctcaaatgtcgataaatatgcaggatgaattggaaacagctcaacatatgtttccatattctcacttagtcggtcgtagagcttagaaaactccgttaagtgttcacgaattttagctttttgtaaatcatttttcttaagtaaacgttgtgaaataacataggcaatatcttctttaacaatacgtacttgctcgaagcgttcctttacccgtcgcagtggatccgctacataatagaaacgtgggttatcgaatagcatctcctgaatcccagccataaacctaaacctgctatcatacgctacttcacctaactcacgtaagaaccctaaatccaatgtcatttctaactctttacgtgaacgaagataatccagaagttcatcgacgactactaataaccctttttctggatattttgtattgaaggcatccatcatttccagtagccattctttattattggttaacttcgaatcatcttctggaaattcaaagttgacatccatttcaataaagcctttttcgagttgtgaaataataatatctttgaacgggcgatccaccccaccaatttcaaaccggattaccttgaattgtccttcaatttgtttagcgtgctcagctacttctttatttgcaatatgcttactagcaccttcatactcagcaattgttgagattactgacattaaatgagatttacctgagccatagttaccaacgaccaataatcccttgttgtcttctggtctagtgtattgtagttgcttaaaaataatttcattaattgtttctgccatgcgatctgagattacgtatgtatccaacaggtgcattgccttttctgttgaatttgcatctgttaattggatgactgaatcaattggttcaaaatttactaattctttatacagcattttcttctcctatccaaaaaaataattgatcttctctcatttcaatacggcggtattccttgtgcccaggttgtgcatatatgagagttgtcccttcaatatcataatgccatgcaatcaaaacaacttttatcttacttagttctagcaatagatccataaaattgacacctaattctggattcattatcaattcaaagttatcaaacagaacaacttcttctgaagattgttctattattcctttgataaaatcagaagcagtcagataccaacttcgccgactctttttcagaagtaattcacttaaaggtagattcaaatttacgaattccactctatccatattaatttctttatcttggctagatactaccactcctaacttctggtattgttttttcaaatgagaaataaacatccatatatcatccattatctatgatctccttttgaacaaattggtgtatttatgaacattttaatagataaagacgaaacaatatccgcaatatttcaaaacaacctgattgattttcgataatataaaataatgtcttatcgtcttttcacaattaaaaaactgaaatataccttatgttatctatcagtgattataccatgcaaatttgagcatataatttttttgaaataatctgaccgggaatagtaagtcaatttatatcttctcgatagtatagccctatccgttgtcggttcaacctcaattgatcacctagtggcctatcatcaactcctaatttcaattatttttttacttttcaaaccaatcctcaagctgatctgcactaattttattggacagattaattaacgccggtcttaacgtctgaattgttttcaccaactcttccccaccaaataatcctataaatgccttatctgtcagctcttcagataaatggttgattaattcgctggttttctgctgatctgccaagatatttattagtttccccactaaatactgatcttcaaaattactatccgcaaaaaaatcgtaattatcgacttcctgcttaaccagtttaatcatatcatcttttttttcataattaaattcacctgctacatccatgtattcgatgataccgctcgtaataacggtgactgcctcatctttcttctgtttagataattcatcggcaatcggtaaattttttatctgatcacgtaccattttttgaatttcttctttaatgacttcttgttgcagttcataaaaataatcatccataaactcctcacatggataaccaacttcattttcccatgccggatttttaaactgcccagtgtaaaactcttctttaattcctttcacaacttctggatgttcttgcacaatcctattctgcccttttagctgcaaatagtccgcaatatattcttcaatatcaccaaagtaaaaccagcctactggtttcccactgatactagataactggttaatgacactttcaggggccagtgcatagccttgaacataggagctaatcgttggtttctttatccctaagcgattgcccaactctgtaaaggacagattcatactctctttgatttctttgattcgttgtcctaccttcactttatccggttgtaataagccaaacatagattacttcctccttgtcattttcccctattatatcactcgtataaaatttcgtatatctttttttctaaacctcttgactccgtataaacaaacgtataaaatacaaatcatagatggccgtctatatttttttaacctaatcgtataaattatcgtatatataaaaaggagggctattatgccaattaaaatcaatgatctcactttaccaaaagaaaaactcgagaaagaataccaagtcgtcaacgttactcgctggcaaaaagacggagaaattctaggttggagttacgaatgtatcctacctaaactccgctacgaaaaaatcagtgtcaaagtcaaatctgaacatcctgtaattacaccggaagagcttacccaacaaggtttagccatggttacatttaccaacttagtgattgcaccttgggggcgctctaacggtcaattcgtcagctatggcttatcggccacggcagatgcggcaactttgcttccgaaaaaacaaggccccactacgcaaaactagttttcctatgagtttgttgggtggttaggacgaaacggcggggcagcgccatagagccgcttctgtccgttaagaccgcccaataaacacataggctggaaggactgctttgcaggacttccccttaacttgatttatagaacaacatcaggcgaagaatgatggttctttgacaactgaatacacatcaaggagtgatgatttttgaaagcttataatcaaaaaatcattgaaactcccacgtaccttgaaatttatgattatgaagcaatcattactcctaaacaaaaaacagaaaatattgaaaccaatccaaaacgaaaaaaagaactagcctggctttatgaagaagaaaatacgactactgataaaagaaaaaactatgatgacctatctgctcaagggcaatacgacagcttaaaacgaaaacaaaaatactatcaaaatatgcgctttgaaattgcccgactcgtggatatgaactttgacaatcagacaaaatttttaaccctcactttcagagaaaacattcaagacattgcccatgcgaataatgaatttaaaaaatttatcaaacgactaaactacgaactctatcacacaaaaaaagcaaacctaaaataccttgccacgtgggaaaaacaagaacgaggtgccatccattaccacatcattttatttgattttccttttatctccgtcaatcgccttacaaccatctggaaacatggatttgtcaaaatcaacaagattgatgtagatagtatcgaaaatcgtggacgctatattagtaaatacttcgataaagacttggatttgaaagagcataaaaaaaaggcgttcttcaaatcgcgcaacctcaaagtgcccaacgtcacaaagcaactcgtggatcaaccttttgataccacaaatcaagacgtactttataccaatgagtatctcgtaagacgtccgatattttacagtgcgataaatgaaggtggaaatcctgaacaagggatggattttcaagaaagcattgttcgctatacaaaaataaaaaaatgaatctcgaaagtaggtaaaaatatgactgttactgtaccgattgaatttaatcaagaaataattgaagaacttgttcaattaacgaagcaaaaaattgaggaagaacaaacgcaacaaccaaacttaaacgagttgcctccctatccaacaaggaaacaattaaaacaacacctaaaaattggggatactcgcctcaatagttggattaatcatggtttaaaaatcattccttttgggaaagaaactcgatttgaccgtgaggatgtaaaactatttttagatagtctaaaaatctagccttgacttacctgttgtggctgcctatgatacccataagaaaggagtaaatcttctctttgatatactggcgagtgaatcaaaggagacaattatgatcaaaaaatatcaaaagaaaaatggcacaatcgcctatatgttcaaagcctatcttggcattgatcctgttacaggaaaaaagaaatacaccaccaagcgtgggtttaaatcaccgaaagaagccagaaaagcttacaatcgcttgatggtgcaagtagaagaaaatgatgtagtgacagattcacaacgccttttttcagaattggcagatgagtggtttgaacaatacaaaaatacggttcgtgaaagtacctatgtcgcccaaaaattagcttacaaaaagcatatcttccctctttttggcaatttgaaaatctcaagaatttcaattccatactgtcaaaaacaagtaaatcattggtatagctattacaagaaatattccaacttaattggtttgacttcatcggttttcaagtatgctttgagtttacagctcattcgaagtaaccccatggatgctgtaattcgtccaaaacgtaaaaagcgaattgacgaagaacgctattccgcaccttactatgaaaaggaagaactattggagttcctcgaaattgcaaaaaactatccagatcctatttatccaatttttcggattttagcttttacaggattacgtaaaggtgaactcttagctttacgttggaaagacattgattttgaaaaaagaaccctttccgtcaaacaaaccttagccacatgtgataaatgggaagtcaaattccaagttcccaaaacagaaaagagccttcgaacaatttcgatagactctgaaacattacaagtgattaaacaatggcaattgaagcaaaaagaatattttctaaaaatgggaatcaaaccggcaaaaaatggtgaacagctcctatttgtatcagaagaaaataaaccgctttatttagactatgtaaatcacaacttaaaaatcattataaaagagaataacttaaaacgaatcacacctcatgggtttcgacacactcattgtagtttactctttgaatccggtgcttcactcaaagaagttcaagttcgacttggacatacagatattaaaacgactatggatatctacacccatgtcacgaaaagacagacggaagaaacggcaaatcgttttgcagatttcatgagttccacagaggaaaaacaaggaagtttgcagaaggtcaaaagtatggtcaaaagcgaaaaaaagcagactatccctatcagatagtctgctaaacgttggtatatcagcgtttttcttattccgcagcgttcgcgtctttgagaccgtattttttgttgaaacggtccacacgtccatctgcttgtgtgaatttttgacgtccagtgtagaatggatgtgaatcagatgttacttcgacacggatcaatggatacgtgttgccatcttcccactcaacagtttcttgtgaattctttgttgaacctgataagaatttgaaaccagtagttgagtccatgaatacaactggatgataatctggatggatatcttgtttcatttcttcttctctcctttgccctggtccatttgctgtaccagagttgatttgtcgattttacaacatgactatcttaccatgtttcgtttttcgatgcaattatctttttagatttctttttggccgtttatcgccaaaatgtacgtcatgaaaagcagacaagaaatccgcattggtttttgtttttcttaaaaactgtaggaattgttccgtgaattctaatgagtcaccagtcatattattgcgcaagcgccaagtctcttctaattgttcgctgctcatcaagagctcttcttttctggtaccggatttcttgatatcgatggctgggaaaatacgacgctcggctaaactgcgagagagctgcagttccatgtttccggttcctttgaactcttcgtagataacatcatccattcggctgccggtatcaactaacgcagtggctaaaatcgtcagactgccaccttcttcgatattccgagcagctccgaaaaatttcttcggtttgtataatgcggctggatcgatcccgccactcaatgtacggccgcttggtggcacgactaagttataggcacgcgctaaacgcgtgatactatccatcagtatcacaacatcacgcttgtcttcaactaaacgcatggcacgctccaaaaccaattcagagacccgagtatggttgctaggctgcagatcaaaggtcgaagaaacaacatctcctttgacacttcgttccaaatccgtcacttcttccgggcgttcatcaatcaataagacgatcaactctacatccgggtgattgtcagtgatcccgttagcgatttcttttaatatactagtcttcccggctttcggcggggcaacgatcaatccccgttgaccaaagccaaccggcgccagcatgtcgatcatccgtgttgacagacgaccaggggtagtttccaatttcaaatgacgattcggataaagcggcgtcaatgcagggaagtgcggtcgttcttttgcttcttccggatctttgccattcacagattctacatgcatcaaaccataataacgttctgactcttttggcggtctcgctttccccgctactttgtcgccatttcgcaaactgaagcggcgaatctgagaagaagaaatatagatatcttctgcactggggccataattgattggacgcaaaaagccataaccttcctgtccaacgatatcaaggataccttccatataaaagaaaccctgtttttctgcttgggcccgaataacagccagtgataattcttttttgttcatttggctgtaataaggaattcgaaattctttggcaaacgtgtagatttcttttagcgttttgttctccagttctgccattgttagatagtcgctcatagttactcctctaccatttgaatgtcagcccctaaggctgtaagtttatcgattatatgatcatatccccgtaaaatatattcgacattgaagactgtggtggttcccgtagccatcagtccagcaattactaaacaagctcctgctcgcaagtctgatgcaacgacttctgcgccatgaagctggctcggtccgttgagcaagatcaaattgccttccgttgttgcttgcgcacccatccgtgcaagttctggtatgtgattgacacgttttgcatagattgtatccaaaatttctgacgtgccatttgctttcaaaagtaagggagtgatcggttgttgcaagtcggtagcaaaaccagggtatgggtatgtttttacattggctggctttaaatctttcgatggataaacatagatttcatcttcactgatatccatgcgcacaccaatttcttctaatttagcgatgtagctttcaagatgctcataaatgacatttttgatggtgattccttcaccggctgctgccgccaaagaaagataagtgcctgcttcaatccgatcgggaatgatcgaatggcggcaaccgtgtaattcttggacgccttcaatgcggatctcgttggtgcctgccccacggatcttggctcccatgttgttcagcaaagttgccacatcaatgatctcaggttcgcgagcggcattttcgatgatcgtcttgcctttagctttgacagctgccaacatgacattgatcgtcgctccgatagataccatatccaagaaaatccgttctccggcaagccccgcttcacttgtacgcaaatacatcgcgccatgctcattcgtaaccgtagcccctaacgcctcgaatcccttgatatgcagatcgatcggacgaggacctaggaaacagccgccaggtaagcccacgactccttcaccgaacttgcctaacaatgcgcccatgaaataataagaagcgcgtaaactattgattttgccgcttggcatcggaatcgaaacgatctcggttggatcgatcgtcagtgtgttttcttcaaagtgcgtttgaacacccataatttctaaaatttcaatcaatgagtgcacgtcttgaatatccggcaccccttctaatacgacaggagaatcagccaaaatcgccgcaggaatcaacgctactgcactattttttgccccgctgatcgtcacttctccttttaagggacgattgccttgaatgacaatttttttcatctatatccacctatactttagagtttgtgtgtatcatgccaattttagcatagaacagacaaagaaaaaagcaggatttccccacaaaaaaagaacgatcacttgtgatcgttcttttgaactgaaagaattaagctttaccagctgaaccgaaccagtcaatgtgttcttctgcatctttgatgattgcagctttacctggtgccaatagtttacgagggtcaaaacctttaccttcttggtctttaccagcttcgatatattcacgtgttgcttttgcgaatgacaattggaattcagtatttacgtttactttagaaacacccattgaaattgctttttcgatttgttcttgaggaataccagaaccaccgtgtaatactaaaggaacatcagaacctacagcatcagcgattgcttgtaagtggtcaaaagcaagtccttgccagttttctgggtattgtccatgaatgttaccaattccgcaagctaggtaatcaataccagttgcaaccatttgtttacattcttcgatgtctgctaattcaccagctccgatgatgccatcttcttcaccaccgattgaaccaacttcacattcaacagaaacgcctttagcatgtgctttttcaacaacttctttagccaatttcaagttttcttcgaatggtaaatgagaaccatcgaacataactgaagtatagccaacttcgatacattccattgctgcatcgtagtcaccatggtctaagtgaatcgcaactggaacagtgatgttcattgattcaactagatcacagataagatctttagcaagtttgtatccgcccatgtattttgcagcacccatagaagtttgaataagaactggcgcttttttcgcttcagcagcttctaaaatcgcttgagtccattctaagttatttgtattgaatccacctactgcatatccgccttgacgagcagcttttaagaattcagctcctgatactactggcataaaaaattcctcctaagttttaaaaaactttatttgttaagcaatgcttaaccgacactgctattttagcaaacatttgcagtatttgctactaaaagatgtaattctcttttcaataaaagattgcacaaattaaaaattctttgcttttcattttcttttctgaaaaaactttgtgaaactagcctctcgtcttacatttgtttgcatacaataacaagaatacttctgaaaattcgagaaaaaattcacgaactttttcaacaatttatcattttcccgctgacgatatggattgcctatcggacaaaaaaagactatttgtttttgagcatatgaatagctctggcaggtggagtatactatcatgaaaaaaaggagggatagaatgaaaaaaacagtagtgggatttatagcgttgttgggtatattctttttagcaagttgcggagcaaatggagcgagtcaaaaaaccaagacattcacgaatgaacaaaacggagttcaaatggagttggtcttcaattacgaaggtgacgaagtgaaaaagcaaaccgccaacaatatcatgccttattcttctgttggcgtatctacgaaagaggaagcaaaacaattattggatccgatcgccaaacagtatcaggcaatcaagggtatcgattattcgcttgattacggagaagatgcagcaaccgaatcattgacgatcgattacagtaatttagactacgatgcggcaaagcaattgccaggggtcacatttgaaggtgatacttcaaatggcatcagcatggaacgaacggaaaaaatgttactagaccaagggtataccttgaaaaaataaactattcctttgagaaacgagcgaatgtggaatggtcctagaaagatcatccctactggcccctgaaaaaggggcttttttaatgaaaaccagctttcccccgtttcttcttaacggaagaaatgggggagctgttcttcgtatgtttcttttgcttttttacttctttgaacgagtccatgcatcccatcctctcaaagagatagtgccatttgctttggtaatccacttttcttgcctgctccgttttgagaccagctttttttatcttttttcctagaaaaatgttccacctgccatagaccaagaaaagacgtccacgatttcactcgaatcgtctcatcgtagacgtctttcttctttgattgttattcttttgtgttcaatgaagaaatatgctgatcaatcatctgctttagcccatttacttcttcataaagtaaattgaactctttggccaactcactcataatatctgcactcattaacaagtcctcggcgtgactcaataacaacgacatccaaactttatcaccttgtgcttcttgctgtaccaattgccgatgagcaatatgtgctttgtgataatgactcttgccactttcaatcgcagatagggcctcttttgtttgctcttttcgcatttgttgaatactttcgaaaaagcaacttcttgccatcccagcttcggaaataatttgaaaacaaatttgttctttttcttccatcttactctcctatcaattccagcgcttgttctagtgctttttgtccgtccatcataccgtaagttcgcatatcaatagaagctgttgggcaagccactaacccttgaacttctgctaaacgataagaaacctgtggacctaataacacacaatctgcatctttagccacactagctaccgattcgattgaaaatgcgtcaatcgatactggaatagcttttttttgagctgcttgtttcatattatttactaagacaccagtagacattccaccagcacaaactaaaacgatctttttcatcttaaatcccccacttaattttaatttataggctgtcagtacttgttatgcttgcgcaatttttccttcttctgccagtgctgctttatcttgccagcgcatgaaaggaatataaatcagcacgcataacacaaattggatcagctgagcgataatcccttgccagccattcgttaagaaaccgccaaaaatgattggaaatcctgttgggatattgacgccattatgataaggcataaagccaacaatcgttaataaataagctgataaaacagaaacagctggtgttaccataagtggtatcaacatccttatgttcatcacctgcggaatcccaaatttgattggctctgagattccaaacatagaaggaatcaatccaattttcccaacagctttgagctgttctgatttgcaactgaaaatggctaataaagctactgcaaaggaacgagcgccgcgattgttgagtataaaaccaatggtaaacaaatgtggcaatggttggccagcactataggcagccaagttgtctagcataggttgataaaagaccagcatcaacactggatagacagctaatacaccatggataccgaaaaaccataggaattcaataaatgccacaataatcatgcaagcaaacacattggcacccaataaggttagcggtgcttgaacccacgtgtagatcatatctgttaacgttccatatggagtagctgctattacaacataaataatccccatgatcgtggaaacaatcactccaggaacgattgcagcaaaggacttattgacaattggtgggactgagtctggcattttgattgtcagattcttttccacacatagaatataaatccttgcacctagtatcccgccgaacattgcaacgaacattccactagaacccagcgtcgaaaactcgatcactttggtctcttcgaatgttgcgatgggacttaaaatcaagaatgaaactaaactcataatgccagcgtttaattgatctgcattcaaatgttccgccagtttatagccaactaagaaggcaacatagacggaaatgacatcgatggtcatcgcattgatttgtgtcaacaatgatttaagacctatttgatccattatttgttgtgtattgccaatatcgatggcattgattaaagaagcaatcgaactgatcatcataatcggcattaaccccatcatggcattagagatcgctttcatataaacattattttgcaccttaattgctcccgccaacaccttattcttaaacgtattcataatatcctcctatccttaattttgtaagtatttttctcttaacaagcggattttttgttgggaaaaaccaagtttgttgaccacatagccctcaactccaccataagctccgattcgcgccaatgcattctgcaaaaaatgacgatcagcttctttaaaatagcgcatcgcctgaacaaaatcgggattatcggtctcttgaagcaacagctgcaggcttttctcatttttttcttttttgtatacattggttaagagatagtcatgcaacacatctgcttcactgacgccaagtagtaattgaatgagagcgacgccataaccagtgcgatctttccctccacggcaatgttggacgattgccccctcttcagctaagtgaatttctaagacttctctataaacgtcttgacactgtttattttcaacaaattcttcattctgacggatcattaattcttttgccagagccgccgtcattttttggggagaaagtgcactttcttcatcatgttcagaagaagctagggcagcaatatccgcaatgggtgtcaaataaagaatctctgcattaccgatcggccgatcttcattattcagtctttcctttttatttcgataatcaatgatcttactgattccaagttgtactaacttttcttgatctgcagctgtaatcttgcttaattcatcagaacgatagagtcgcccacgtatgagacgctttccttctttgttacggtagccgccaaaatcgcgaaaattgtatgctcctgatagtttgatttttttgtctgtcataatctactcctttaagtgatggataaatgtgatgaagtcattcgtcgcaatcagttcgttcactttctcagatgatgtacatattttgatcaaatgatcgtttagcgacttagcctttaaatggtcttgctcagcaatgactagtaagaagaccaaacgaaccgattgtttataccaaaatattggtttcttcaaatgggcaacagcaatcactgtttccgatccaatcaatacattggggtgtggaaaagcaaccatcggcaagaaatcggttccaaaaaaagcttctcgttcaaataccaaagcttcaaaattatttggcatctgatattgttcgttaatgcaatgacataaaaaatgcagcacttcttcttttgtttcaaagtcttggtcacaaataaacagcggttccttaaagaaggtcaaaagtttttcaacggtaaaaacagtcgacagtgcatcagctatttttttgatcatttcaggccgcataaaatagtcaaaactcattacaggaatggttccttcataaggtagatcgattgatgaaaagataaaatcaaagtcttgttcttttaggaactgagcaaattcatattgattacaaaccgttacttctttaatgtaatttcggaaatagaattcaaacttttcttttaaaaatgcattggctgctctccccagatcgtttacaactaaaatatacttacgctgcgtttgtgaactcttcttattcagggcgacatcaaagtgcatggctaaatagctaagttcatgatcgctgatacgcttattgaaatgcgcaacgattacttgaccagcaataatagctaagtcgtatcctacattgcaatggacttttacgtcatctaacagcgggtttttcagctcaattcctaattcgattcgatcaatcaaaggaacaaagtgaagcatcagcatcgtctgtaagtccaaatcttgactgaagtcaatttgtcttcggtttttgattttttttagaacttgcctcactaagtccgaaacttcctctgagacaacgtttttttcatttttgggaatgacccgtttccccacgatctgacgaagcacataatttcgctcacattctgtaaaaagaacaccgcattcttcttcgatccgcttgacgattcgcttgcctaataatgattgttcagcattggttcttcctccaataggcagattgcgatccaagtagcggccgctttgcattcgcattacagcgattgctaggtgattgactaagttcgtcactatagcttctgaaatcggataggctttttgagaaaactcagctaaaatgattgcttgaatctgtcgatgcaactgcgatggcgtcccttcactagaaggtaattgatgcagttgtttaaggtgtgtcttttgcagataattgcttgccataaagcgacgtaagtcgaattcactgccgcaaagcttcatgccgtagtaaggctttgtttggatggataaattataatggcttaaaatccgtcgcagttttttgagttcttgagataacttgctttgtgagataaataagcgttcacataataattctgacttgatgtattcgtcttcttggacgaagtactcaatgatttgtgtcacaaaatcttcttgaggtgtgttttctaagctacgttgaaataattcatgattgattatttgtaaaaacaagccacttcctttcttcccttgaatcacacagccataaagcgattggctttgattgattttctccacatatctacgaactgttttcgtactgacacctacttttgcagcgatctctttggttgtcataaacccgtcttgctctgaaagagccctgatcaacaataagcttattttttccatctttctctccctcattaattagtttagagtctattgtagtcaacctccataggtatatggtcccttttattagggtcaatttctacaagaagttttatctttaatagttaggagtagctgaaaaggcgtatcacttcggatgctactaaaaaaagcactagcactggctagaacggaaacacccttcaaaagttaacccaaaaaactaacttttgaagggtgttttatgagaacgttcctttataaatgggtcgagtgatcctgactatatttcccccacatttatttagagcgtactcttatgcttaaaaaaaggctgtaggcctcccttttccgggacattgcctacaacctgaaaccagctcaacagctggtttttaatctggtactatatgtgttacccacgattgtctaatgatgcaccaacaaatgctttgatcaatcgttgtggacgtgttggtcgtgaaatcaattcgggatggaattggcaacccacaaagaatttattttctggaatctcaacgatttcaactaagcgattgtctggtgagacacctgagaagaccataccttctgcttcaaagatttcgcggtatttattattgaattcataacggtgacgatgacgttcttgtacgacttcttctccttcataggctgcagctgttttcgttccttttttgactttacatggatacaagcctaaacgtagcgtaccgcctaagttttcaatattttcttgatctgccatcaaatcaatgatgttgtttgctgtatcgggatcagtttctgccgaattcgcattttctaacccaacgacattgcgggcaaattccacgcaggccatttgcattcccagacaaatccctaggaatgggacatcattttcacgagcataccgaatcgcttcgatcttgccttcgattccacgatcgccaaaaccgccgggaactaagataccgtctgcatcctgtaagtattcggcaacattgtctttcgttaattcatgggctttgatccaatcgatcgtaatgtcggcatcataagcaaaaccagaatgtttcaatgcttcaacaacagacagatacgcatctggcaattccacatatttccctaccaatgcaatgcggactttctttttcaagttcaatactttttcctctaatgcttgccattctgtcatatcagctactggcgcattcaatttcaagtgatcacaaacgatttgatccattccttgtgcttgtaaagccaatgggatcgaatagagtgtttctacatctcgggattcgataaccgcttcaggtgcaacatcacaaaattgggccaatttgttttttgttgattgggacacaggttgttcagtccgaaccactaggatatttggttggatacccaatcctcgcaactcttttacactgtgttgcgttggtttggttttcatttcacccgctgcctttaagtaaggaatcaacgttgtatgaatgtacatcacattgtccgaaccaacgtcagctttcatttggcgcaacgcttctagaaacggcaacgactcgatgtcgccaacggttccgccgacttcagtgatgatgacatctgaatcggtcatttttgctgcccgcatgattttttctttgatttcattggtgatgtgcggaattacttggacagttgctcctaagtattcccctttacgttctttgcgcaaaacttctgaatagatttttccagtcgttacatttgagtatttgttcaagttgatgtcgatgaaacgttcataatggcctaagtccaaatctgtttctgcaccatcatcggtcacgaatacctcaccatgttggtatgggctcatcgttcctggatcaacattgatgtaaggatcaaacttttggatcgttacttttaagccacgattcttcaataagcgtcctagtgatgctgccacaatacctttaccgatcgaagaaaccacaccgccggttacaaaaatatattttgtcataaactgaaaaactccttttaaactattttgcaggaaaagtacttagaaaataagaaaagctccctatccataaatgaatagggagcgaaaattctaaatcactttctgactctttttcaagagtgcccaaacagaatgatacaatcttgcctagcaaaagtcaagcaaacttttctcgaatcctttctggatgcggatacatcgaaaaatcgctgatttcgatgaacattcacaaatcgctaaacttctttcttactttcttaatggattctttgggtctgcttgtcataatgattcttgtagaggaagctcggtgctttacttgttttgttacaaatgatcagaaatcgttttcttatcatttttgcgaaaacaaggtgcaggttcgattcctgtcttctactttgaatagattacagaacaaaaccgctagattggttttctctagcggtttctttttttgtatcggttgtcacagacgcttcaatagattctaaggaccatcttccaatgacttattcgtttgttgcctctgcagatcgaacgactagtaattgattagtacaattcaaggtactgctcgcgttcccactcagaaactgtttgacgaaaagcggcccattccaaacgtttggcttccacaaagttcgcaaaaatgtgtttgcccaatgcatcgatcatcacgtcatctttacgcaattctttgatcgcattgtggatcgttgatggcaggtcttcgatttgtgcttctgcacgttcttcttcattcatcacataaatgttgcggtccactgcaggcggcggtgtcaactcacgacggataccatctaaaccggcttgcagcaagacagccattgccaaatacggattagcggatggatcaacggagcgcaattctaaccgggtggacaagccgcgagattcaggaacacgaatcagtggtgaacggttgcgtcctgaccaagcaacataaaccggtgcttcgtaacctgggaccagacgtttgtaagaattgactgttgggttgcagactgctgtataagcacgggcatgttcaatcaaaccggctaggaaatgatacgccgtttggctcaactgcattggtccttcttcatcaaagaagacattttcttttccattgaacaaggacatattgcagtgcatacctgacccattgatgccatataatggttttggcataaatgtcgcatgcaaaccgtgtttgcgggcaatcgttttgacaactaatttgaaagtttggatgttatcgcacgcttctaccgcatcggcatatttaaagtcgatttcgtgctggcctggtgctacttcgtggtgggaggcttctacttcaaaaccaaggctttctaattctaatacgatatcgcggcggcagttctcacctaagtcagtcggtgcaaaatcaaaatagccgcctttgtcatttaggtctgttgtgatttcgccatcttcatctaatttgaaaaggaaaaattccggttcaggcccaagattgaaagaagtaaaacctagagattccatatctgatagtgcccgttttaaattgccgcgaggatcgccagcaaatggcgtgccatcagggttgtagatatcacaaatcaaacgagcgactttgccatgctcactttcccatgggaaaatcatccaagtagataaatctgggtaaaggtacatatcactttcttcaatccgtacgaatccttcaatggaggagccatcgaacatcattttgttctcaagtactttttccaattggctaactggtacttctacatttttgatcgttcccaagatgtcagtaaacatcaagcgcaagaaacgtacattctcgtctttaacgatttgtttgatatcttcggctgttctttcaattttcggcataatatcccttcctttgacctttattctttcgtgccacaacattgatctacattagcggacctttttgttggaatggctgttgttgattcagaccaccttgcgctaggagttcgtcataaaagattcgacgaacatcttcgtcagtcagtggcggtttgttctttgcttcttgttctttggcaattttcatctcgtacacacgtttgatcccagccatattcaaaccatctgacagatagtctttgatttctaatagcgtatcgatatcatttaatgaatacatgcgtcgattaccatcactgcgttctggatggatcagttcttgttcttcatagtaacgaatttgacgagccgtcagatccgttagtttcatcactgttccaatcggaaagacagacatcgaacgccgcaactctttttcccgcataacgtggcgcctccctcatttagatgatcctgcataacttaattgaaactataccaattgttttttccactgtcaacccttcatgtaagaaaaagtgacatagacatttatttttttctgtttggcagaacaatcactagaaaaccatccttttactggtcgaatgaaaaaaatttccagtggtaatcactgaaaaaaaactgcgtgcaggtattagaattccctacacacagctcgaccacttcatttcctgagcgttactcttcaattgttggatagatcccggcagaacctggcaatgcaaaaccttttaggtgataggtttgatcttcctcgtcaaagtcattggtaagcaagagtgtttcccgcttcaaacggctcaatcgcttgccttcattggcagctaaaacggtttgataaggctgcatgatttgcatgagttccattttaattgcttggatcagttgttctttccctttactgctcttggcagaaatcaaaacattggggaacagcgtcggcacaaattgttctggatcaatgcgatcagctttattatagatcgtcagaactgggacttgcgtcaatgatagttcttccatcaatgctaaaactgttttttcttgctgttgccgatcatgagaaccagcatcaaccacatgcagcagcagatccatattttgactctcttctaatgtagaatgaaaggcatcgatcaattgtgtcggcagttcttgaataaagccgacagtatcggtaacggtcacttccaatccttccggcaaccgccaacgctttgtcaaaggatctaacgtcgcaaacagttggtcttgctcataggtatccgcactagtcaataaattcaaaatcgttgatttcccagcattggtatacccgatcaaaccgatctgaaagacttgactgtcgcggcgtttctgacgggtacgatcacgatgagcagcgacttccttcaactctcgtttaatgatcgtgatccgattacggatatggcgtcgatccgtctccagtttggtttctcctggtcctctcgttccaataccgccccccagacgggacatatttttcccttgtccgatcaatcgaggcagcaaataatctaattgtgccagctctacttgcagttttccttcttttgaacgagcgcgcatagcaaagatatctaaaatcaattggacacgatcaataactggcgcccctaattcttcaccaatcaactggctttgtcggggtgtcaattcatgattgaaaatcaccaaatcagcttcatgggcatccactaactgttgcagttccgccaattttccttttccgatcactgtttgccgatcaacttgcggccgtttttggatcagtgaaaaaatcacctctccgtttgctgttttggtcaaacttttcaattcattcattgaggacgcaaaggtcgaataatttcgttctgtttctacgccaacaaggattacgcgttcttgtgtcattccttctcctccaaccattggtcgatcgctttttcgatcgaagatacgtcctcaggatgctggacaagatcgacccatctaggagcgagacgattcttgaaccaagtcagttgccgtttggcgtacctgcgagactgttgtttgatttgtgcgaccgtttcttctaatgaacatgtaccggcaaaataaggggcaaattctttgtacccgattccttttgctgcttgggtctcaggatggatcagcacctgttgtgcttccgcaaccaaacctgcttccaccatttgatcgactcgctgatcaatacgctgatacaacaactgtcggtctgtggaaagcccaatcataaaataatcgtataccgcttccggtgcagtagtcggggctgcaatgcttattcccgttgtttccaagacttccaacgcgcggatcactttacgttcattgttgtaatggatctttgctgcggctaaaggatctaatacctgcaacttttgccatagcgcttctttgccaattcttgctgcttcttgctggtagcgctgccgaacggaaggatcactttcctcagcggctcctaattgatagtcatagagtaaagcctggatgtacaatccggttccccctgctacgataggcagatgacctcgttgatgggtggccgtgatcaactcacgggcttctttttgaaattctgccacagaataggattcatggctgtcgcgaatatcgatcagatgatgagggattccttgcatttctgcagctgttaccttggctgtcccaatatctaagccacgatagatctgcatggagtcgccgctgatcacttctccctgatactttttcgccagttcgatgcttaaggccgtttttccaaccgcagtcggtccgactaccacaatcactttttccatcaatgagcttcctcctgaaccttcctttggacttcccggactcgctcaggaaaattggtaataattcccgtgacccctactgcaagacagtgacgaatttctgcttctgtatcgactgtccaaggacgaatggcaatcggataatccgcgatctgttcctcatgtttcttgacccactcataggcaggatgaatcccttcaatgtaagggcgcgacaatgctaacggaggtttcgcctccgattttcccataataaagtcaaaggttgcttgcggttcaatcgcatacaatcgatccaatgtgtcaacattgaatgaacaataccaatgagtaaagggccagctttgactggctaacaattcagatactttcttttcgatcccttgatactcgtaatggtctgttttcaattcaatcgttaaaataccacgataattctttgctgctaaaagatcgaggacttccttcaacgtcggcacttttgtggcggcataatcttctgagaaccagctgccggtattcaattcttttagttctgtcagcgttttatcacaaattcggcctttgccgttcgtagtgcgatcgactgtttcatcatgcattacgatcaggtgaccatcctttgatagatgaacatctagttcaatgatatcggctttgacccgaactgcttctgcaaaggctggtaacgtgttctctggacggtctccactactgccacgatgggcaacgatttgtaccatttgtttcactccaatctttttctattttaccacggaaccccatagaaccaaactcctactccttgtgccatcctcattttctaaaggcatcgctaggatttgtatatatcagagaatcgacaaaaaaagaggctatgacagaagtttttccacaaaatgatcctcccaacaatcatgaaattgctcctactctgcagcaggtcttcatcaaatacacgatggagagcgcaattccgttcacgtccttcggatcatctcgttgcaacttctgtcacagactcaatgttatagccccattctcgattgactcgactataatggtttagaaaaataagttaatggttcattggtcaaatttttcatttgcgttttgcgctcattgaccatttcagtcagtgtatccaagaaattctccatgatgacacgaccgcctttatacgtataaccgccgatcttcaccgtttcttctggtgaaaggatcactctgcgggtaccgattttcttgaaaaattcttctaaaaaataattcggcaaataaaagttattctgtgcggcaaaagactgtaaataagcaaaatcatcgatcgttatataacagtcatcgaaagcatcgaaactgacatattcgtccatcaggatcacccgtttttgtaaaatttcgctgattttcctgttcaattggagaagtgtctcgatttctttgactttatgctccaacagccgtcgccgtttttctttttgttcatcgtaacgaattctgagattgaagatgatcgttactaataaggcgcctactaatacgccgataaaacctgcaatcgctactgccattttcttctgaccctttcatgcttactttctttttattgtatcataatttaaaagagaggcaaaaaagataacgaactttttatttgacctttattgacctaatgggtatacttacttttagatattgcaaaaactttgtgctaaactatatctatatcgatttttaggaggactaaaaaatgaatttaattcctacagtcattgaacaatcatctcgtggcgaaagagcctatgatatctattctcgtctattaaaagaccgcatcattatgttaagtggtcaagtaacagatgatttagccaattcgatcatcgcccaacttttattcttggatgcacaagattctgaaaaagatatctacttgtacatcaactcaccaggcggaagcgtcacagccggactagcaatctttgataccatgaacttcatcaaagcagacgtgcaaacgatcgttatggggatggctgcctcaatgggttcattcttattgacagctggtgaaaaaggcaaacgctttgctttgccaaatgctgagatcatgatccaccaaccattaggtggcgcacaaggacaagcaacagagatcgaaatcgcagctcgtcacattttgcaaactcgcgaacgcctaaacaaaatcttgtctgagcgaacaggtcaaccaatcgaagtcatcgaaaaagacacagaccgtgataacttcatgactgctcaagaagcaaaagattacggcttgatcgacgagatcatggaatcaaacagcttaaaataattcatccatcaaaaaaccagctgtgctgaagcacgctggtttttttgcgtcattaaacgagatccgattgacttcgcttgccattaataaacatatttcccttgcaagtagtcttttcccaaggaaacataatgggcgatattggctttgtttttggcaatttcttcctctgtcaacggacgaatcactttagcaggacgtccaaaagccagcacattgggcggaatgatcgttccttgagtaactaaagaaccggcaccaatcaaactgttttcaccgataactgcatggttcaaaacaatggaactcatgccgattaaggcccctttttcaatcttacagccatgaagcatgcactgatgaccgacagtcacatcttctgcaatgatcgtgggtgcatcatgatccacatgaatgatcgtcccatcttgaatattggtccgctcacctactcgaatataatttgcatctccccgcaaaactgcttggaaccagacagtcgcctcactgccgatggtgacatctccgacgacagtcgcatttggcgcgataaagttttgcgtactagcagtttctgcgtttagttgatttcgtttttggctatttgtctcttttttccgatccattgttaaactcctttaggatttttctttctccactacactttactactacactttactactatactttactactatactactctattcctgtacccatgataccatgaataactatgaaaaccacgaatcagtccgtaagagaacagcgactatatgcggatatcttcacacttcatacaaaaaaaagagtgcggctgacaccacactcttttgacctattctgcttcttctgaaaactgactctgataaagctgactgtaaaatcccccagctgccagtagtgtttcatgattgcctttttctatgattgctccttgatccatgactaagatcaaatcggcttcccgaatcgtagacaaccggtgagcaatgacgaaactggttcgtccttccatcactttgtccatcgctttttggatcaacgcttcgagccgtgtgtccacagagcttgttgcttcatctaagatcaagattttcggattagaaatgactgctcgagcaatcgtcaagagttgtttttgaccaagcgagatattatccccttcggaattgataaacatctcataaccgtccggcatcgtccggatgaaatgatccacattggctgttttagctgcatcgaccacttcataatcggtcgcatctaacttaccaaaacgaatattgtctccgatcgttccttcatacaaccaagcatcttgcagaaccatgccgaataacgaacggacatcgctgcgggccattttcttcgtatcaataccatcaatcttgatcgccccttcgttgacatcgtagaaacgcatcaacaaattgatcaatgtggtctttccggctccagttggtccgacgatcgctaccgtctgaccagctttcacttcaaagttcaaatctttgatcagcggtttcttcggatcataggcaaaaccgacatgttcaaattgaacatccccatgaaattccgctggcaatggaatatctgtttggttgactggttcttccggttcatccaaaatctcaaaaacccgttttgcagctgccgaagcactttgtaagacagaggaaagctgggtaatattccccattggctgactcacttgccaaatgtattggataaaggcttgcagttgccctaccacgatcacaccgccaattacatagaaacttcccataactgccatagcaatatacgtaaagtaggcagtcatttgaactaacggcatcatcaatcccgagacgaaggccgaacggaagccgtaatagcgcagttggtgattgacttttttaaagccgtcaagtgtttgtttttctcgtccatagactttcaatacactgaaaccagtcatattttcctgaacataaccgttcaagtctcctaatgcattttgcatgccttggaagtctttttgcgatttcttgacgatcgttcttgaaatgatcaatgacgttggaatcatgatcaatgcgatcaacgccataaacgaattgatataaaacatcatcgctaccgccatgatgattcctagaaaggcattgacgatcccgatcaaggcttgctgcatcgcaccactgactgcatccacatcgttcgttacccgtgacaagatatttccttgctgatttttgtcaaaatatgaaacaggcaagcggttgatcttttcttcaatgtcttgacgtaaatcacgcatcgcagattgaacgacatttgtgatcaaaagccctgacattaattgtgagaaacaataccctacaccgacaacggtgatccagatcaaacaaacgatgatgtaatcaaaattcagcggctctcccgctgcaatattccgactgatctctgttgtaggcaatccggacacatacggcaatgccgcgttaaagccaactgtagcgacagtaaaaagtaagactaaaataaaggagactttgtagggtttgatgtagcgccctaaacgttttaaagaagagaatgctttcattgtgccaactcctcctctgataattgtgatgctgcaatgtcgtaataaaccgagcagttttccaacagttctttgtgggtgccgataccaactacatcgccttcattcaacacaatgattttatccgcgtgcatgatcgtccccacacgttgcgccacgatcaaaatagttgattcggtcgtttcttttttcaaacgcgcccgtaatttggcatcggtttgataatccagtgcagaaaaactatcatcaaaaatatagatctcgggacgacggatcaccgcacgagcgatcgccagccgttgtttctgaccaccagaaaagttcgtgcctccttctgctagacgtgcatcaaagccatccggtgttttagcaataaaatcagctgcttgtgcgatctcaaccgcacgttctaagtccgcttgtgtcgcatcttctttcccatagcgcagattttctgcgatcgttccagtgaacagcaacgctttttggggaataaatccgatcttatttctcaaagcggacaagctgtactcgcgaacatcgatcccatcaatcaaaacctgtccttttgtgacatcataaaaacgagggatcaattggatcaatgttgatttcccgcttccagtactgccgatgaaagcaactgtttcaccaggagaagcagtaaaactaacattgcggatcacaggactctcagcatgtcccggataggcaaatgtcacattcttaaattccacatatcctttggtcttgccttctgtcactggctgttcggcttccacgatttctgaagtcatatccaatgcctcctgaatccgtcgggctgagaccgctgcacgtggatacatcgtaaagatagtcgcaaacaacatgaatgagaatagagcatggaagatgtattcgataaaagcaatcaagtcaccgacttgcagttgcccattttcgatttgaatacttcctgaccaaatgatcagtaccatcacgatattgaataagaagaaaaagcccggctgtgctgtcgccatcaaacggaacaagctgcgagagctggatgcatacgcttgattgactttgctaaagcgtttctcttcaaatttctcatttacgaacgcacggatgacccgtaaaccagacaagttttcccgcaaaataccattgatcttatccaaattggcttgctgcttgttagacaacggctcggaaatctttgcgatggctatcacagcaatcaacaagatcggcagtgcccctaacacatacatccctaattttgtacttgtccgcatgaccatatacaaactgaccgcaaacatcatcggcgtcatcaatccaatccgcagaatattctgcaagaacaacatgatttgatatgcatcattggtcacccgagtaatcaaggatgaaacaccgattttttcatattccgtatgtgaataaccttgcaccttttcaaaaagatcatctcgaacatctgctacgatattcgttgtgattcttgaggtaaagtaccctaacataatattcattgcgatccctgtcaaagtaatagcaatcattgccattcccatcttccagatatactctcggtcaccatttcgaataccgacatcgatcattcgagccagcaatgtgggtaatcctagttcaatcaaaataaatccaaacacacagatgaaattaaaaaccaacagttttttattgcgcattgtgtaatgccacattaatttcaaaaaagcccctcctttttttacacattatttttactatatcatagtcccaatttcaagtaacccacttcccgaagaaaaaaaggagatattttaaagtatttttttaaggatgaccaagggaagccctttcaaaccaactagtttctatacttatttacttttctatgataaactaatactacttgtaatggaacgatttacaaaaaacggtgaattttttatgacaacatttggaaagcaaagacgaggctttctcttttttctcacaacgattgtctggaaaaagcatgtagcggtccactgacgacccccacttttcaggtcacttatctagggccttgattttgtgatgcaccgaatcgaacaaaacgataaactactgcattagcagataaaggagaatttgtatgatttacaaagtttactatcaagaaacaaaagaccgcaacccaaaaagagaacaaacccattccctgtacattgacgcagaaagcgcggttgctgcacgccgtacagtcgaacaaaacaccccatataacatcgagtttattcaagaacttgatgaaaaacatcttgcgtatgaaaaagagaacgctgatttcaaattagcggagttttaataatgaaagtttctctaaaaaataatgaaactggcgtattcggcgtcggcggactaggcgagatcggaaaaaactgttatggggttcaattccaagacgagatcatcttgattgatgccgggatcaaattcccggaagatgaactacttggaatcgactatgtgatttccgattatagctacattgtccaaaacatcacgaaagtcaaagggttagtcatcactcatggtcatgaagatcatattggtggtattccttaccttctgcgtgaagcaaatatcccaatctatgctggtccattagcattggctttgattaccaacaagttggatgaacacgggttactgcgagatgctacattacatgagatcaatgaagataccgtgattcgcttccgcaaaacatcggtcagctttttccgaacgacccacagtattcctgatgcgctaggcgttgtggtgaaaacaccttcgggaaatatcgtagcaactggtgactttaagttcgatttcacacccgtgggcgaaccagcaaacctacacaaaatggccagaatcggagaagaaggtgtgctatgcctcctttctgacagtaccaatgctgagattccgacctttaccaagtcagaaaaaacgattggtagttcgatccgcaagattttcgaaaaaatcgaaggccggatcatctttgccagcttcgcttccaatattttccgtttgcaacaagcagcagatgctgcggttgccacaggtcgtaagatcgctgtcttcggtcgaagtatggaaaatgcgatcgttaatgggcagcgcttaggttatatcaaagtccctgacggtacatttgtcgaatctcatgagatcaatcgcttaccagctaatgaaaccatgatcctatgtactggctctcaaggggaaccaatggcagcccttagtcggatcgccaatggtactcatcgacaaattcagatccatccagacgatacggtcattttctctagttcaccgatccctggaaatacgactagtgtcaaccacttgatcaacttgctgttagaagcaggtgcacatgtgatccacgggaaattgaataatatccatacctcgggacatggtggtcaagaagaacaaaaattgatgcttcgtttgatgaagcctaagttctttatgccggtccatggagagttcagaatgttgaatatccatacccaactggcacaagatgtcggcgttccaaaagagaactgttttattatggaaaacggtgatatgctggcgttaactgcagattctgctcgtcgagcaggtcatttcaatgcgggtgatgtctatgttgatggtagtggaattggcgacatcggtaacgttgtcttacgagaccgtcgtatcttatcagaagaaggcttagtgctagccgtagccaccgtcgacttgacgaaaaaagaagtcttagcaggaccagacattctttcccgcggattcgtctatatgcgggaatctggcgagatgatcaatgaagcacaacagatcctgttccgtgccctcagagaagtcttgaaccagccagatcctagcgaacataaaatgcgagaagccatgtcagctgctttgcaacccttcttatttgaaaaaacagaacgtcacccaatgattctttcgatgatcatgacacctgacgaccactaacaaaaaaactcgaccaaaccctcaatggaagtggtcgagttttttatttttcatcctactgacttccttaggtttaagactctcttctttcgaaattagacgcaggattatcggtactgtctcttgccacagctatttaaaactactttggaaacttagctatattggaggctatattaaaaactgtcttaaaaacgatctaagaagtgatctcaccgatacatctcttcaggagaactatctacttttcgctaagcaccagtttaatggttttaacttcatatggatgcaatgaaaatgcgatcggctccgcttttaactcttcgctagcttcttccatcatgttcgtctcttgccagcgaattttgccagttccatgacagtgaatggtgacgtcgcgatcgctccctaaatggtcatagcaacgcaaaatccacccgctttgatcttccgctaacttcaatgcgtcgattatcaaactttcatcagcctcgatttcaagaggaatacttgccatctctgtttgaagttgactcaatggtgcattgatctcccaagcttcttccatcacctgaccagttgcaaaatctccttgatgcggaaataggctgtaggtaagcgtgtgggaaccaagatctgcctgaggatccgggtatgttgctccttttaataaagataatcgcagctgattgcctttgatatcgtagccgtatttgcagtcgttcaaaagggccaccccgtaatccatttgtgcaacatccgcccactgatgacctactgtctcaaatttggcgatatcccagctcgtgttccagtgagttggacgcttcacattcccatgctgaatatcaaaaatagcttctgtcgcgcgaatattgacatcaaatttcactttcaacaattgctggcgttcttgccaatccaccgtggtaacaaaatcaattcgcttcgtatgagcatagaaatagattttttgtaaaatagttgactgcccaaaagtgacttgctgttctaagacagtaaacaaaggattgttcgcgatgacttgaatgcctgcactgcttagctccgtgcctttttcttgataaaaaagatcgatatcccacgcatcgaaattcaatggtttgtcttcaaataattgaaagacattccctgtcccagcaagcacttctcgttgtgcggttttgtcatagatctgggtcaaatgccccgcctcattccatcggacttgataaaacggagtctcgagtcggtctttttcactaacggacactgcttccaatggcaacgcacagatacaatccggcaaaagactcgcttggaatgctggcaaatgtaccagagcgtaacaggaaccgtcgaagaaaacttgctgctgttcaggtaccgtgcccggtgctactgcaatgatgcttgttcgctgccaagcggctgtattgatgatacgtaattgttgttcttctgtctcaagagcagttgtcagagcatgaagctgcttttgacaagcaagtgcttcgttccgataatcttgatagacttctttgatggaagagcccgggataatgtcatgaaattgattcttcaagacgcttttccaaagcttttcgaatactgcagcaggataagccgttcctgctgtcatagactgaagactgtacaaacattcaagttcccgcaagcgtatttcaaaccagcgattcattttcttgataaaggcctgcgaagtataggtaccgcgatggtactccaaatacagttccccatcccagattggtagatcgttcgaattttggtcgacagtttcatgtaactcttcaaaaaagtcagcagcccgacccgttttaagcatcggtaatcccggaatttcagccatctttctgcggttttccaacatttctcgggtgacaccaccgccgccatctccatgtccataggaaatcaatagatgttgattcaatgctttattttgatagctgcgatatactcctaaaaccgtctccggggtcagcaacccattatacgtgtaaaaccaattggatttttctgtccagctgccaccacctggaacgggtgtcgtgatgaaatgcgtcaaaatttcagagccatcgatccccttccatagaaaggtgtcgtttggcatgcgattgtattgattccaacttattttcgtcgtcataaaggtattgattccactttttttcagaatctgcggcaacgcccatgaatacccaaaaacatccggcagccagagataggtgctttcccgcccgaattcctcgcgaataaacttttttccgtagagaatctggcgaataagggattcgccactaggcagattacaatctgcttcgacccacatggcgccatcaacttcccagcggccttctgcgattcgttgtttgatttgcacatacaattcaggatagtcctctttgatatattggtaaatttgcggctgggtttgaaggaacacatattctgggtattctttcatcaatttcaagactgtagaaaagctgcgggccgccttttcacgcgtgtgcttcaactgccaaagccacgcaagatcaatgtgggtgtgtccaatcgctgtgacttgaaccaagtcacttttgggaagtgcttgcagcgcctcttttagaaaaagatgtgcttcccgcaaactatcataaaactgcggtgatcctttttctcgccaatcgatccgttgaaacgaaccattcaacatcttgagcagccgaaccttccggtcatgatcctctgctaattgctggatcgtttctaaaatcattttagaaagataaaaataattgttggcttcttcatccaaataaccgataaatgcagctttcagttcatgggtcagctgccgttcttcgccaccgccttctagtccagaccatagcttcagcgcaacgatcacttcttttcctaaatttgcaggttctaatagaaattctttgtggttggcgtcgattccctgaacagggacaccatcaataaataaaagtgattcaaaaccagagttattgccgccaccagtttttccaaaatcaaaaaacaatatattcatcttcgggggaatggtgactttcgcttgaagccataaatagcgatcccttccttgccacgtttcccctatgtgcatgacttgttcagtcgaaaagagtggcggatatttctgacactttgtctgatcctctgtgacaaaccattgctggatctgacgcttgtttcgatacctcaatgcctcgatttcttgaatgcggtgcttgatttttgcttcttgcataaaataatccattttgttctgctcctttggcattcacttggttttcctactgcttattcgcccttaagttagtcttgattaaagcgttcaaattgttgccgacggatctccaataagcgttgagcaccgatacgatccaattgctgcacatagttggtccaatccttttcaaaattccattcacctgtaatgaactttacccgcgattgttccacatgggttgagatatctgtaacgatcgttgacaattctgctgcttctgcttcggttgccataaatgtcggcagcatgtattccggcatatattcttctttgacatcatcatagacagccggttctttgccaaacgctcgatctctgatttcttgatccaattccgcataagggaaatagcctccatacacattatcgacccactggaaagcaccgagttgcggcccgttttgatagtttaagatttcgtcaatatagaccatgtgcccatcttcgtcaacttcataggtcactccttcttctcctaaataagcaaaaatctgcccttcaggactatagaagtaatccacccactcaagaagtaatcctggatctgctgcatccttcgtaatgataaatgctgaagtaccagaaacaggcggttccgtataaagtgtcttgtcgccataaggtccttcaatgacattgatcggcgtatacgtttctggtccaaatgggccaatgaaatcaggatcgacccactggaagagaccaactttgtcttgggcagcatccgctcgccatttgtcatcatccacgccggcaaaggattgttttgcaactaatccttctgcatacaactctcttaggtacatccagacttcccgcatccgttcatggttgatggtcaactgtaattgccccgcttcatccacaaacagcatattccccatcgcctgtctgccgcctgtccccaatccataggaagccatcaagaccttttccagtccgccggctaaccagccacttggcatataatacccttctcgtccttccccgctcgctacaaaagcagctagaacctctttcagttcatctgttgtacgagggacatccaaggacaattcatccagccaattttgattgatatacagtcgaaccgttcgcccgccgctcattggatccaaagacatatacggcagcgagtacatatgaccatccggtgctgttaacgtctttttgacaatcggattttcatctaagattttttgcagattcggtgcatgttcggcaatcagatcttctaatggaatgaacaatccttgctgtccgtatttcacgatctcatcattgctccagccggtctgataaaaggcatcaggcagctttcctgatagaatcaaattcttcttttccccaaactcttttacttcttcccactgtactttgactccagacttcttctcgtactcttgccacatccacaggtcttcgcttttcggcctcacgtctgtaaaatcattcctcattaaatgaatcgactttacgtcatctgctactttttcacttggactagattggcaagccgacaacagccagacgaaggacaacaaaaacaatagcactccttttttcatacagttctctcctttttatacaatcgaacaacgggcgacatcaaaaatagactcctttcattttgttaaatttattgaaaaacaagaaacctatcccataagcaggcaatccgatccctaaacagatccctaaaaatggatagtaacaataaagaagactaaccaatccaagaagtcccatacttattaatagctgaacgggacaaatgaacacaaacagtaacggctgtaaccaacgatggactttgtctaatgaaaaataagcatgcacagggaaaaatgtgatcgccagcaataaaataatcaggagattcgtccgcatcgtaaactcaaacaagaaactggtgggataatcactcgctaatgtgtgatgaaccccaataacaaaaccagtcagaacaatagccgcaacatgaaaccagcgatttttttgtttgttgtgccgatattgatctgaaaaaatttctttgagaggagcttcatttttctgcagaatcctttttcgaatgcaatcgtagacagtaatcgttgccggtatcagactaaacagcacaccgcccagaagcatgtagcgccaccaatacacattcaaaagcatcatatcgtacactaattcacaaaatgcagcgatcgcttttagcatcgaaacacctcctcatcccttgatggatcctactaggatgcctttttcaaagtatttggctaccacaggataaaataggagcacaggcagacttgaaacgatcactacgctgtatttgagggtcattttcagcataagcagttcggattccgcactaccggcaatgatttggttcatatcttggccaaactgtccctgaaccagtatttctcgcagaataatctgcagaggatacttggcacgatcctgtaaataaatcaacgcgtcaaagtaggcattccagcgaccgacaccatagaacattgccatcactgcgatgatcggggtagccagaggcaagacgactttccataataaccataaatcgttggcaccatcgatataagcgctttcaatcaaatcattaggaatattttgactgaaatacgtacgcatcaaaatcatattataaacacccaacgctccaggcaagatcatgacccaaagtgtgttaacgatccctaactgctgattgactaaataagtggggatcaaccctccgctaaaaaacatcgtaatcgtaaaaaataaagtaaagaaacgcttgcctcgtaagccggaacgagacaatgggtaggcagcaatcgtcgtgacgattaagttgatcactgtccctaaacccgtgtagatcactgcgttgcgaaaacccgtccagatatcactgctcttgagcacttccttgtacccttcaacatttaatccacggggatacaaaagcaacgggacctcatagatcctagtgggatcactgaaggaagcattgaccacaaagataagcggatataagataatcagggcaatcagactgaccagtaagatattgatagtattaaacagtttatcccctttcgttgctgatactttcattcgttttcctcctaccaaagactcgattcatttgtcttttgtgctagtttattaacaataaataaaacaataaaattaatcacgttattaaaaagaccgactgcagcagagaaactatactccccatttatgatccccattttataggtatatgtcgaaagcacctcagaggaagcgagattcgcagcgttctgtaagagaaaagtcttctcaaagcccacggataaaatgcttcctgtcgccaatatcgtggagatcacgatggtcggcatgatggaaggaatcgtgatatgacgaatacattgcaagcgagaggcaccatccaagtaagcggcttcatattgatcgggagagatcccggacatcgctgccgtataaatcaacgttccccaccccacaccttgccagacacccgaccacacatagatatgcggaaaccatttaggacttccgagaaaatcgatcgatggaaacccaaatgtattcagcaacatattaatcatgccatcttgacttgaaaaaaagaattgaaccatcccgatcacgacaaccaccgaaataaaatttgggatgtatgaaatcgtctgagcggttgatttgaaccatttccgattcaattcattgaataataacgccaaaatgatcggtaatggtacactgaccaacaaactgtaaagactcaagcgcaaggtattaacaatgatctcgagaaaaaaataggaagcaaaaaaacgctcaaagtgcttcaatcccacccaagggctacctaagatcccaaatgcgggagaataatctttgaatgcgataatcacgccatacattggccaataattccagatcacgacaaaaataactggaatgatcagcatgacgtagagccacttgtgtttctttaaacctttttttagatcctggaaatttcttttgtttttacccagatagccgatttttgcaactgtaccttttacaggcatcttgagtcccctcctccatttaactaggtttgtctttttgtgtcgttatgttaccttcgatgctaaaaaaatacgtccaatcaaattggagcactttaccgatccgcttcgctacttctacacttggtcggcgttttcctcgttcaatcatattgtaatatgttcgctcaatttcggattccttagctacttgatcctgagtgagtccatttttttcacgttgcctaatgagccactcccgcatacagttccctccttcttcggaatgtaacgtttcgacacacactcattatatgtttccttatgacacttgtcaacgacatttagtaacaaatagacaccaaccgactctttttttctaagtaacggtgtgttactatcacgagagaggcaggtgtcattatgtttccgcaaatcataaaaaaattacgtctggaaaagaagttaactcagcaagaagtggcagacaaaatcgggatcacacgtccagcttatactgcctatgaatcaggaaaaagagagcccgactttagcatgctgcaagtgttagccgatctatttggtgtgtcgaccgactatctcttaggccgatctgataagagacacctctatcctaaagtagaaagtgacttgatcagttcccatgtcgatgaatcaatctcagaagaaggaatcaaagaaatcctcacgttcattgattttgtcaaagaacgcgagcaaaaaaaaagaccatctgaatgatggtcttttttgactgtgccttcactaatcccatgaatgcagtcttgtaaataagcttacgctttgtttacgtttactgcttgaggtccacgatctgattcttcaacatcaaaagtcactgcttggccttcttctaaagtcttgaagccttcaccttggattgctgagaaatgtacaaatacgtctgtaccgtcttcacgtgaaatgaagccaaatcctttttcagcattgaaccatttaactgtaccttgttccattataaaaaacctcctcgtgcataagcacttaattatgtgtaacattgctcgtgtccgatagaggtgtaacaagcgtttcaacatctattcagcaaacaaaattacactaatattttacacttgctactatttttttgcaaggtagacgatcagccttcccagagtccttcttctcgcaagctgatatatgaattattgccgataatcaagtggtccagcaagtcgatacccatcaattccccacacttcatcaatcgtttggtaaaggtaatatccgcctgcgaaggttggggactgccgctgggatgattgtgcacgcagatcactcgggcggcacagcaacgaactgctccgtgataaatttctctaggatgagcaatcgactgattgagactgccgatgaataacgtctttttttggatgatctcatttttggtatttaggtagagacacagcaaatgttcttgctggtaatcttttaattcctccatcatctgattggcaatatccacactggaatgaactctgccatattttggctgtgctgctcgttggatgcgggcgccaagttctacggtagctttgagttcgatcgctttgatctggcctaccccacgaatggcctgcagttcgtccaatgtcacgtgctttagctcatacaagtcttcaaactcgttgaggatctgaccagctagttcgatgacattgaaaggatgagaacccgttcgtaaaagaatcgctaacaattcttgattggataaagcttcagcgccataatgcaatagtcgttctcgaggataggaactttgaggaattccattgtctttcataaaaaaaactcctttgcgttagtctaaaataaaactacgcaaaagagttcatggttgatgcgacactaccaagtataggcctgctcaaaataatccggcacttctaccagtgaaggcaagatatgcagcactttttcttcgatcactgacgtcggagcaaccagatcaggtaccatgatcaccggaatgccagctgcatgcgcagcatgaataccgttagcggaatcttcaagaatgactaattgatttttcggaacccctaagcgattatgggctttttcgaaaatttcaggatccggtttcgcccgcacaacatcatcgaaacaaacgatttctggaaattcttgcgtcagacctgcggaatccagcaatgtatcgatgactcgtcgttggttgctagaagcaaggatccgcggaatccctttttcatccaaatagcgcagcaagtcatggacccccggttttaatgctgcttgaccttgctcaaagagcagcagagtttgatcaaaagcggcttggatgaaacgatcaacagtctctggaccgaaggcagcatcatatcgttcatgataagccgcccagacttcttcatctgaaacaccaacgtatgctagatagacatcttttgtataggggatctccatctgatcggccacgatctgtgttgcctgatagtaaagaagctccgtatcaaaaatcagtccgtccatatcaaaaatcacaccatttaattcagccatttcttcctcccattcccaacaaaagttcccgaacttctgatacaaaataaagcgaaccagtgatcagaagcaagtcttcattggtcattttttctaataattctgctaagccaaactgccatagtgaaacgatcgagatgcgcgcttcattcaattgctggtaatcatcacttaaatggatcgcttttggaaaatcaaatgtggtcaaatagatttcagctttcgggatcgttaacagctgttgcagcatctcatcgacattttttgtctccaatgctgaaaacaagatatggatgcgatagttggtgaattcttctctaactgtctcaaccaagcgttccatggcgtgcgtgttatgcgcaccatctataatgatcagcggttcattgctgattttctccattcgcgcgggccaataagctttctttaagccattgcggactactttttccgaaaatggcagtttttttaactcacagaataaataatataattgaatagcgacaccggcgttttctggttggtgtcgaccaatcatcggcgttttcagtcctttgatttttccgcggtcattctcaaaatcgaaccactctccccagatttcatccggacgatgatacgtgactcgatagtcttctcccaagtgggatacaggagcctcagattctgcagcttcaaggtcgattacggatagcgcactttcagggatcttcccagtcactagtggcaccttgggtttgatgatcccggctttatgggcagcaatggcctcaatcgtgtcaccaagcatatccatatggtccattccaatagtcgtgatggccgtcaagattggtgtgatcacatttgtactatccaaacggccgcctaagccaacttctatgatagccacatcgacttgttgctgggcaaagtagccgaatgccagtgcagtcaaaatctcaaattgggtgattccggtcaattcttcttcctgatccagttgcatgacgagtggttgaagtgtttcgacccattcaatcagcgagtcatctggtataaaacgcccatcaatctcgatccgttcattgaaagactcgatatggggcgatgtgaacgttccaacttgcagcccactttcttctagaagacttcgtaaatagctgacagtcgaacccttgccgttcgttccggcaacatggatcaatgtcagatttttttctggattgcctaatcgttgtagcaatgcttctactcgcatcaatcctggacgcatcccgaaggtctttcttccgtggatccatgcaattgcttcttcacttgtcatgttcttcacctcaaaatcattttagcaaatcttccctttttttcctaattctactgctctttctctcagagcgttcccaacaaaaatcgataggaaaactacccgatctatagcggttaggaattctttcctctatagatcgggtagctagagatcgggtagttagagagtaaatagttagatcggtaatttgcaacagctagtgttccataggaatatcgatgattagcttgctgcctcgattcaataaatagattattgaatcgtacgcaattgctcgatccgttcttgaactgctttttgtttatccaaataatcggcttctttcgctcgctcttgcgccacaacttcttcaggggcattggcaacgaaacgttcgtttgctaatttcccttgcacgcgtttgacctcttgattgaatttcgccaattctttttctaaacggctgatttcttcttcgatattgatcaagccggctaatggcaaatagatcgttgctccggataagatagctgacatcgccaattccggtgcttccagtgtattggaaatcactagctcttctggattgcagaatcgttcgatatagtttttgttggtgatcaggaagctctcgatctcaacatcgttggtttggatcagcaatgtaattggcttagaaagcggcgtgttgacttccgcccgaatgttgcggacagaacgaatcaactcttttaacacttccattccttgtgctgctttctcatccgaccactctggctgaacttctggataagcagctactacaagcgaatcgcctgtatgaggcagtttactccaaatttcttctgtgacaaacggcatgattgggtgcagcaagcgtaatatttgatccaacacatgaaccaaaatgctcttattgacttgtttagctgcttcattttcaccatataaggtttctttgctcatttcgatataccagtcacaaaagtcatcccaaataaagttgtataactggcgacctgcttcaccgaattcaaaacgatcaaacaactcagtcactttctcgatcgtttcatttaaacgagttaagatccaacggtccgctacggatttctcgccagaaaaatcaatatctgtcaccgtcattccttcaacattcatcaagacaaaacgggacgcattccaaatcttgttgatgaagttccaagcagcatccattttttcatagctgaagcgaacatcttgtcctggtgcagagccatttgataagaaccagcgcaatgcatcggcgccatatttttcgatgacttccatcggatcgatcccgttccctaatgacttactcattttacgtccctgttcatcacgaatcagtccatggatcagcacattttcaaaaggacgtttgcctgtgaattccaagctttggaaaatcatgcggcttacccagaaagcaatgatgtcgtagcctgtgactagcgtgttggttgggaaataacgctgataatcagcactattttcatctggccagcccatggttgaaaatggccataatgcggagctgaaccaagtatccagtacatcaggatcctgtgtccagttttcggcatctgccggtgcttctaagcccacatacatttcaccagtttcattgtggtaccaagcaggaatttgatgtccccaccacaattgtcgggaaataacccagtcgtgaatattttccatccagcgcaagaaagtttgattgaagcgcggtgggaaaaactcgactgcctgatccgtcgattggttgtcgatcgcttctttagccaatggccccattttgacaaaccattgcgtagataaacgaggttcaacaacgacaccggttcgttctgaatggccaacactgtgaatcattttttcaatctttaacaaacgtccgatatcttccaaatctttgacgatcgctttacgagctgcaaaacgatccatgccagcatatttaccggctaaatcattcatggttccgtcatcgttcataacattgacccgtggcaagttatggcggttaccgacttcaaagtcattcggatcatgggcaggggtgatttttactacgccggttccaaattcttgatccacgtaagtatccgcaatgattgggatctctttattaactaatggcaaaataacctttttgccgatcaattcttggtagcgttcatcctctggatggacagcgatcgcagtgtctcctagcatcgtttctggacgagtggtggcaatctctacggtaccagaaccatctgccagttcataagtcatgtggtaaaaagctccttcgatctctttatggatgacttcaatatcagataaggccgtacgtgcttgcggatcccagttgatgatatattcgccgcgatagatcaagtctttttcgtaaagagttacgaagactttacggacagcatctgacagaccctcgtctaatgtgaatcgttctcgactatagtcaagagacaatcctagctttgcccactgctcacgaatatggcctgcatattcttctttccattcccacacttggtcgacaaatttttcccgaccaaggtcatagcgggagatcccttgttctcttagtttttcttcgacttttgcttgtgtcgcaattccagcgtgatccatacctggtaaccacaatgtatcaaacccttgcatccgtttttggcgaatgatgatatcttgaagggttgtatcccacgcatggcctaagtgtagtttaccagtaacatttggcggaggaataacgattgaataaggcttggctttttgatcaccacttggtttgaatagatctttggctaaccattcctggtagcgtcccgcttcgacttcttgcgggttgtactttgttgataagttatcggacattgttttacctcctactttttttgatcagttccttcaagaccgctcggcttttgggaataaaaaaagtcctaaaatgccgaagcattttaggacgcaaatacgcggtaccacctaaattgtagatttctctacctcttgggcgtgagttaacggtcacgaagcgtttgattctactgaacaaggtgttccttgctgttccaatcaaagactcacaagctaccttctcagattcctgctgaaaaccttgcaccaattggtcttctctctgtaaaaacagtccgtctgatactcctcttgatcctcgtcttctttcaattgatcttgttcattctacaatgaacttttttgaaagtcaaacagcgattgatctggcagcggccaaagccgattgatagtccggttcttgagagatttcaggcacgatctcttcgtagcggatcacccctttttcatctaagacaaaaatcgcgcgggcaaaatgtccaaactctgggatcataatttgataggtttctccaaacgtattttctggatcatgcagcatcagcatatcgatcccttcttgtccacaccaatttgcttgttcttctttcgtattgttcgagattgtcacaaaattaacctcatcaatcttacttgcttcttcattgaagcgcttcgtctgcaatgcacagacccgcgtgtcaatgtcgggaacaatgcttaagatcgtcggtttacctaagaaatcagccaagcgataaactttgtcatctaaacttttcagttcaaattctttggcttgatcccctacttttggctgaatgcctggtacttcaaaaatgattcctttacgtgttacttgcatgtcatctctcctattacagttttctccagtataggagagaacccgcgaaagccaaaagattttgctcaaaacctacgatttctgagaataggtattgtcaaaaaagatcaacgtctgtaattctgtcgtcagatcgatgtattggatatgaacatttttaggtacattgacgcgatcaggggcaaaatttaaaatcgctgtaatgccagattctacgatcgtatcgattgccgcctgagaatattgactaggtactgtcgagatagctacagtgattcctttctcctgaacgatctcagctagctgatccattccataaacatagtgaccgtcgatggtcttaccgatcaattggggatcattatcaaatacagcaacgatcgaaagattctcattgcggcgaaagttgttgtttgcaagagctttacctagattgccaaagcccactaatgcaatgttctttgcttcgttcgtttctaatatatggctaaaaacttcaatcaagtaaggaacttcataaccatacccgcttcgtcctaattcccctaagtgggaaaagtcccgacgaatcgttgcggaaggaacttgtgtgatctcagcaaactcttttgatttgattcgatggacacctgatgcatccaaaaattttaaatgccttaaataagcaggcagacgtttcgctgttgctttaggaagttttttttctcttaatgcttccatggtttccgtcctccttgttaaatagttcacatatcgagtttagcatgctcgtcattgaatagcaagcaattttcacaaacttttaatgcttcctagattccagtcaaacgactgtgagaaatctctcacaggtccagcataaacgaaaaaagacggctacttgggcacaccctttgtaaccatcttttttctttaattgccaacagtcaacagctggtttttatcccctgatatcaaaattttttctgatgtgaagatcaaagaaaatcagcgaattctgctttttcggaagcttggatctcttcgattttcaacccagctaatgcccgctccatcatgcctgctatatctaagcgctcttcatataaatgcactttctccaacttcggtcttgtcttaggctgtggcggagcaaaaatcgtgcagcagtcttcaaatggctggatcgccagttcaaacgtatcgatctcttgagctacatcaatgatttctaatttatccatcgttgccaccggacgaatgattggcgtattcgttacttcattgatcgccaccatactttgcaatgtttgtgaagccacttggcctagtgattctccgttcaaaataatcaatccatgacgagcttcacggatcgcatctgtgagtcgcagcatcatccggcgagtgatcgtcatccaatagccttgaggcacatgcttcttgatttcttcttgaacttcagtgaatgggacttcaataaactgaataccgccaacataaggggttagtttctttgtcagatctttggctttttgtagtgcctgttcgctagtataaggcgggctggcaaaatggaccgcttcgatctctaccccgcgtttcatcgcaaaataaccagcaacgggggaatcgatcccgcctgaaagcatcagcatccctttcccactcgttccaaccggtaacccaccagctccttggatcgtctcgtaagaaaggtaggctccatccatacggatctctacccgtagattgatatctggctttttcatttgaactttgatttctggaaagcgatcaattacagcatttcctaacgtcaaattcaactgattactgtcttggatgaattgatggtcactgcgtttggcagtgattttgaaggtctcagtccctgtatagatttcactcatcactgtttgtacggcttcttttaacacttcgacgtctttttctacccgaatgctgggagaaaaattttgaatcccaaacactttttgcaatttcaatataattgcctgactgtcttccccattcagaagcaaatgcatccgatcacgttctgcatgaactttgactttaggaaagtcggcaagtgttcgcttcacattctccgccaactgcataatgaaactgcggcggttttttcctttggttgataattcgccgtagcgaaccatgatctctgtataattcacgagtaaaactcctttgtttgtcgttggtatgttcgcaacatgctcttattggcttaattttgagaacttttgataaagctgattaaatacaatcaaaaattgttctacttcggccatcgtattactttcatccaagctgacccgaactgctgaagtagctaagcgactagggacatgcatcgcatgcaatgtgctgctagccattttcttgcgggaagagcaggcactagtcgttgagagataaatctgtttttcttcaaaggcatggacaagcacttctcctctgatcccttccaatgagaaacaaagaatatgcggcgcaaaatgttcggctccagaaaacaccgtcactttctcatactcagataatgcttctgaaaggtaacttttcaataagcccacatggttaggccgggcagctttttgttcaagtgctagtcgcaacgctttagccattgcaacaattgccggtaaattctcagtcccgctgcgctgattttgttcttgcccgccaccggtcatcaatggtgttagcttacggccttttttccaataaataaaaccgacgcccctaggtccatgaaacttgtgggcagaaaatgtggcaaagtctacccgttgtggcaaccattgctgctgatcaaccttcgcaattgcttgaacagcatccacatggaagtggatgcgaggatgagcttctagaatttcagcgatttgattgattggctggatcgaaccaatttcgttgttgactgccatcacagaaacaagaatcgtttcctttcggatcagttgctgcaaagcagcgacatctacaaatccagtagaagtaacgggtgcgatactcacgtcaaaccctagttctttcaactgttctgcggtctcactgaccgctggatgttcgatgccagaaataatcaagtgattgccataagcttttttggcgatcgcggtgccttttaagacccaattgtctccttccgtccccccactggtaaaccaaatctctgaagcagaaacttgcagcagctcagcaatttgcgcccgagactgttccaaaagacggctggcttgactgcccagatcgtgaagacttgaagggttgccgataatacgctgactaacttttacatatgtatctaatgcttgcggataaattgcggttgtggcgctgttatcaaaataaatcaatgctaggaccctttctttgaaaaattctttcccattataactgctctttcctgctctttcaagaagttcctcttcttggatcgatttgtcggtagagaatccgccaattcactaaaaaagccagacagtttttcactgctggcttttgctttatactaaatcacgattcttgaaatagaagttctcgatccgcttgaaagcacctggttcgacgcgttccaaagctgtcccgatctcatctaatgcatcttgataacgatactctttcgtaaacagatacaaactcttatcaatcgctgctttgatgtcggcatgtgaatgacggtaacggtttgcatattgcatcatttgttctgtcaatgcagctgcatccactaaatctttcgtttgttcatcaagcatgtctaaatcttcttcacaaactgaaaccaatttattgatttcttgcatgttgatccgaattttattcaattctttgcctaattcttccactcggtcagttgcgacaaagaagaattctaagtattcccctggtaagcctggcaaacgctgtttctcaacaaaacgtttgaggttacgtaaacgaaattcgaagttctctactttctcttgtgcgaccttttcaccacggcgtagatcacttagcgcttcatcgatttcaacttgttgcgcttcgacatcatctaaaattttgtaagcatctttataaaaactttgtacttctgaataagggatctcatggttttccaactgcggcaagtattcattgttgcggcgagccaattcatcgacttctgtttggaagccacgaacccgacctaattcattatgattcaatgtatagctttgagcggtatgatccaactcaatcaataattgacgattgtttttcgtcgcatgatcgatgtagtcaacaatcacttgacgatttttaagaacatatttcttcgcattgatttcacgttccattaccgtatacaaagcatcgatgtcactagctgtatcccgattagctacctccacagaagcaacttctgttttggctaaatcattcatagaattttcaacccgttttttcacgcggttgatatcttcttggaagttagcttcaggaaagacgtatttttgatccaataattttttgtatccatcttggatttcttttaattgatcagggaacgtacgattcagctcttcataagcagctgggattcgtttcatcaaatcttcgacttcataggtgtgttgctctgcttgttctaaaacttcccgagcttcgaccggatcaccggaagtattcagcgtaacaaattgagtgaattcaatctcgatatttttgatttgcttttgcagttcgttataagctggaccaaattcctctccatgctcccgcaagtttttcttcaaatcttcataaacatccaatgctttttggacttctagggaattgcgttcttcactttcacgaagttctttcaagccggcacgaatctcttcgacttgacgttccatatcatccatggttgcttccgcttgttcgatcgctgttttagctttgaaaaagcgaatccgttcattcaactcttcgacttcaaagatttggctttccagttccgcaaatgaggaggtggaaatatctgtccattgctggttccattctcggaatgtgttttggctttgacccaccaaatgcatttttttcacttcatcgacttcttcaatgaccggcagatcaaacaggttttctttacgtttctctaagacatccagtttctcctgatttttctttcgcataaagtaaccgatcgcatataagatcgccgcgatgacgacaatggcaataacgattccaaagatgatattagttcccattttatggttcctccaattttcaaatctacacttttcgtatgaaatccgcgttttcacagatccgtttttgggtatgtaaggtatctcaaataaaaggacccacttgtcccttttcaaaaaaagcatctacgctagattatagcataaagaaaaaaatcaagcattaaattgcggcaaaaaagattgacttttttgcgacttcctccaatttttcattctttttttaacaagctctctctaaatttccttggaaaagccgaaatcaaaaaagctttttcctgttttttggtgccttttttaagaaatgccttgatttctcacttttgacactgtactctagaaaaaagcttgaacaggagtaatgcaagatgaaagtagcaaaatttggtggtagttcgctcgcttcagccgagcaagtgcaaaaagtagttgatattatccaagcagatccacaacgccgttttgttgttgtttctgcccccggtaaacgccatgcagacgataccaaagtgactgatcttttattagccacttgtgaaggactagctgcatcaaaagatgtccgtcccttattaacagaaatttatgcgcgttatgctgccatcgctgccccttttcaagtggcgcctgaattattggcagagatccaaagtgctttacagcagtttctgacattgtcgcctaatgatgacccacattttcatgacaagatcttagctagtggagaagacaataacgctcgtttgattgccggaattttacaagcatccggtctagcagcacgttacttaaacccagaggagctagggatcttagtcactgatgaaccccaaaacgcccggatcttgccagcatcttacacaaaaatcaatgcctgggcagaaacagaagaaattttagtgatcccaggattttttgggtatacggaggatggagaaatctgtactttctctcgaggcggatcagatatttctggtgcattggtagctgctggtgtcaacgcgacgctttatgagaactttacagacgtcgatggtattttttcggctcatccaggttatgtccatcacccagaacccatcaaagaactgacttatcgagaaatgcgggaactttcgtatgccggattcacggtgctgcacgatgaagcgttgatgccttcttatcgggcaaagattcccgtcgttatcaaaaatacgaataatcccacacatccaggaaccatgattaccaaccaacggaacaacttgacacaaccagttgtcggtgttgctagtgatgaaggcttctgtatgatctacatccgtaaatacttgatgaaccgagaagttggttttactttacgcgtccttgagattttcaaagaatttgatttaaactatgagcatatgccgtccggaatcgatgatatctcgatcattatgagagccaatcaattaaatccggtgttggaagaagaattgctgcgcaagatcgcttatgagatcgatccagatgaattacgaatgacccacgacttatccatggtcgtagtcgtcggcgaagggatgcgccaacgagtggggatcactgcagacagcacagctgcattggcccgcaagaacatcaacttggaaatgatcaaccaaggttcttccgaggtcagtattatgtttggtatccataaagaacaagagaaagccgctgttcgaactttgtattataccttttttgattgatagtcagtggcctttcccaacaaagccgcccctcaaatacacttagaacaaaaaaacaagatgacccttgcgaatgattttgcaaaggtcatcttatttttatgggtgttcactcgtttcaagtcaactcttcatttttgctacgatctgacgttcaatttcagctttgatgcggggctctggagcaaaacgttcttcccaatccgcaggtttcatgactttatgagtcacaggatggtaatggggcatgccatctggaaaaagtttccccatattggcttcatgaacgattttcaaaattggtgccggatcgacacccaatagtgaaaaagagccataggtgaaatacaaaagatcgcataaggcatcgacttgctcgactaacgtatccgtcactggtttttgtttgctagtgatcttttcttttgcttgctcgattccctgatgcagatccgccactgactgtgcgaactgctcgggatcattgttggccgctgcatacaaaaactcaactaattcttctactttgaaccctgcacggaaactggccttttctggtgtgaatggccgtggttgctccggacgtgtcgggtcaaaggtttgatgaaattcttctgtcatttcaaaaggactcatcttctttcctcctccgttgatctcactcaatcaattcgtgtattccatttattcctctagttatgtgttattcgatgatgccatagtgtttcagagcctgagcgataccatcttcattattagatgctgttacataattggccgctgtctttgccacttgctgcgcattccccatagccaccccaataccaacacctttcaacatctcgatatcattttcgtgatccccaaaagccatggcttcctcgatcgcgatcccttcataagccaaaaactcatggattcccttcattttcgagcctttcttggggacgatatccactgaataggcattggagcgtttgaaatcacaggaaggcagtttttgctttagcttttctttctctgattcgggactcagcataatgcactgataaattggttcccgcaaaatatccagagactgataccgtttggcatttcgatttggactgaatcgctgcagcaatttttttagcaccccaacgggaaacttctttgggacgaatcgcaaataacgttgcatcactggtgattgactcaaacgaatcgtcaagctgccagccactttggtttctccgccaaacattacctgccgataattttcatctgcatatgcaacaatttcttcaaggatgttcttcgagaaaggtttggcataaatcaaattttgtttggtgtagacaaactgcccattataggtgatgaacatatccaaatctaaataatcgatgactttctctaattctacaggtccgcggcctgtcgccacgccacataaaacaccttgttttctggcttctttgatcgctgctcgggtacttgccatcgctttcccgttatctgcgatcaatgtaccatcgatgtcaaaaaaaattgctttaatcatataactcctcaaaatagctccaattggctaggattcagttgttggtaatcgatttgcatggcttcgatcaacgcgcgggcattgtccgccgcatcaccgccagcattattgttaaaaataacagcaacttcttgtgcgtgagccgctgtttcttcgactgcttgacgtagttcacttaattctttctcattgtagcgatagagcgtccgattctttttggcgtcaggtccggtagctgtccaaccaacatcatttctgccatgaaaacgacatacggcaaatgccgggttagtcactagcggttctaaaggaaccgtagtggagagtttcttgggctcatcaacaataaccaacgagaacttttgcttgcgcatataggcttgcatcgaagagcggaactctggctgataccaactattatcccgcaactcgattgccaccggatacgctgcaaaccactgacgtacttcatctaaatacgccacactttctttcgtacacttaaaccggttgggaaattgtgccagcaaacaataaagccggccagcatccaccataggttgaatcgcctgcttgaaagctgttagtgcttctgccatagacataccttccggcaaatcaccttgtgtcgttacgctttgatgcactttaagaataaaacggaagttatccggtacctgcgtcaaccaattccgcacatccttctctttgggtaaataatgataagacgtatccagttcaaccacaggaaagacactggcatattcaaaaagttttgatgtttttctctgaacaagagaaccatgttcactaaatgtcgtacaaccaattcgaatcatttttcctcaccttgcttgttttcttatttgattagtatacaatagttttggagttatgagtaaaataatctttgaggtgacaaaaatgaaaaaaatcctcgttttgcatacaggtggcaccattgccatgaaagaagatgtgttgaccggtggtgtcagtccagacgtcacaaacccattgatggacgcccctatccatatcgatgacgatgttgaactgatcgttgaagatatctttaatctacctagtcctcacattgcacctgagcaaatgctgcaaatcaaagaacgcatccagttggctcatttaagtggaatcgatggcgtagttgtcactcacggaacagatacattagaagaaactgccttttttctagatacaacgatcggcaatcagctgcctatcgtcattacaggtgccatgcgctccagtaatgaagtcggcagtgacggtttatataattttgaaagtgccattcgcgtagcaaaatgtgatgatgctcaaaaaaagggtgttctagtcgttatgaatgacgaaatccactctgctcgttatgtcacaaagacgcatacaacgaatgttgcaacttttcgcacgccaacactaggtcccattgggctggtcacaaaaaatcgaatattattcatgcaggaactattagagagtcgccaattggatgttgatcgggtcgatggcttgattccgatcgttaaagcctatgccggcatgcatggagaactttttgaggccttagcagaatccaatatcgatggattggtcattgaagccctcggagctggcaatctaccaccccaaacattaccgccgctaaaaaaattactggcgaaacaaatcccagtcgtactagtctcccgctgtttcaacggtattgccgaacctgtctatggttattctggaggcggaaaagaactgcaggagatgggagtcatcttttgcaatagcatcaacagtcaaaaagcccgaatcaaattgctgatcgccaaaaatcgtcggctgccattagttgaattacacgactttatggaaaactgattgttgacttttttagaaactaaactgacaaaaaaccgcaccttcgcttgttcttagcaactgaccttttttaagagaaggtcaatcgctaagaacagacgattgtcagtgcggttagttgttttcattattttttgttcgttcatgccacttcattgcggcttcgcagtacgtcgtctctccgattctgatctcatgtaatgtttccaaatggttctcatcccgaatcgtttcaaaatgactttctaccaagttcccgtactcaacttctcggtcaaaacgaatcgttatttccttcacttgatgcgtcgtcaaaaattcatagcctaaaacatccagcagccaattaaaatacattgcattgttgacgtgctgattgctgtcgatatcataaaaccgaacccgataaggtaaaaaatgtcctttttctggggaattgattttaggatagcgcttgatgcgcttgattttctcactttcaaaaggagcgacgatctcatctggaacactgctgactttgcgtgttgccaaatccatcaatgcaaaaaccgactcgatcttcactaattcatttccttgggcgtcgtgcagccagaaatagcggtagcaaaaatatttattgtattcttttgcttgtgttgagaccatgatctgttccccgaccatcggcaaccgattgaccgtgatatggtaagtagtaatgatccatgtcagtccaaaagagcgaatgtattctggcccacgctccaatactgcactttgctcttcggatactttgattgccactcccaacattgctggaaacgtcattgtctgattgatatcgcactcataataagcgacttcatgttctttttgatactttgctaccatcttgccaaatgcctcctaatatctactcaaaatctcatctacattattgccgtaactttcaccgaatagattcaaatgaaccaataaatagtacaactgatacacaggaacccgctcttgccaatttttttccagcgggaagacttgctgatagcgttggaaaaattccggacgaaatccgccgaataattgcgccatcgccagatcaagttcgcgatcaccaaaggatacagccggatcaatgaaaactggatcacccttctgatcaaacagcacattgccgcgccaaaagtcaccatgcagtaaagaaggttgaacctgtcgacctgaccactcttgatacagcgtttctttcagatttaggtacttatcttctcggcgaggattccaatgatttcctaacttggccaattccacctgaacgtctaagcggcacgtggtataaaaactcacccaatcctctgccgcgggattcacctgcggcaataagccaataaagttgtcctgttcaaatccaaacgttgggcttgtttgccgatggatctcagctaaagcagtggcgatcgactcttgatcaccttcaccaacatcgatccattctagcaaaaggtaggcgccatgttcgttatctccatattgataaacggcgggtacgcgaacatagggacgtaattgtgccaatcctgctgcttctgcttgaaaaaactgctgggatactcctggatgatacttcaagaaatactgtctttcttctgaccgcaaccggaacgtctgattcacgtcacccccgctgatcggcgttaatgttccggataacccaaactgggcaagcaattcctgattcatgttggacacatcctttactcggtaaagtgggcgtgaaaatactctttttcgtcttttgtgattgccagtccttcttttaaatactgatccaccgtgccaaattcttttttgatcgctgctaaactttcatcaagaaaactttcttttgcactcatcaatgtggtgatggcttcaagaacttcaggcggcatttgctgcgccataggggcaaatttctcttttaaaaaaggccccagatagcgattcgttgccagatagtcttgtttgatagttgattgatccacctctaataaagataagagcagaaatgccccgaagcctgttcgatctttccctgctgtacaatgaaatagggttgctcctgcttccgcattttctaataccaagtcaaaaaaatgacggtattgctttcgagcatgcggactttcgacaaagtggcgatataccttcttcatctgatcttctgcatcatccccatctgccagcttttgcttcaatgtctctggtgataaggaaaccatcgtttcatcttcgctaaaaatcggcaaaaagaactgctgggcataacggattggctgatctggctgtgctttggcttcttcataggaacgaaaatcaatgatttgattgatgccatagttgctcaatgttgcttgatctgtctcagacagctcattgatcgcggcactacgaatcagttttttccgcttaatggtcttccctgatgtcgttttataaccgcctaattctctgacatttgctgcattttctaactgaatcagttgtgtcatcttgatccctcctgcgcctgtatacaaaaagtatagcagaaacccataaaaaaagcggtgaatatttctttattattctctcatctactaaagatagcggtcagagtaagccataatgacacataataacaatagtgactctgatttttggtcacaaaaaaagaaagaccacacgcagtctttcttaataaacactcttttgttatcacttgattttagtagcggcttctacttgaatcaatcggcatcaatcacagcagtttgactttcaagtgttgcacgatctagttcatggatacgactgctagtcaccacaccggcaaccatgctgtcactgacattaaccagtgttcgagccatatcgatcagtggttcaacagaaatgactagaccaacgattgcgatcggcaagttcattgatcctaaaacgatcaatgaagcaaaggttgccccaccaccgacaccagcaacaccaaaagaactgatggttacgaccgccaccaaaagcaggataaactgccaatcaaagacattgattcctaccgtaggcgctacgatcgtggctaacatcgccggatacacaccagcacagccattttgtccaattgacaagccaaagctaccagcaaaattggcggttgcttcgtcgacacctagcgcttttgtttgcgtttcgatattcaatggcaacgcaccggcacttgagcgtgaagtaaatgcaaaacttaacactggaaaagctttcttgaaataagtaattggattgacttttacactcgctaacaacaaggaatgaacgagcaagacaatgatcaatgctgcataagaagctaaaataaatttcccaagatttaggatcgcttcgaaatcacttgatgctagaacatttgtcatcaacgccaatacaccataaggagtcaaccgcaacacaagtgtgacgattcgcatcacgatcttgtacaagctatccattagatcagcaaacgtttgcgcctctttcggggcttttttcttcacccctaagtaggcaatccctacaaaagcagaaaaaattaccactccaatcgtactcgttgaacgtgtcccagctagatcggcaaaaacattattcggaataaaggatacgatctgttgaggaattgacaagtcttggacttgggtagaacgttctgccaactcagcgatccgtgcggtctccgctgcgccttcagtaaaactcgcaccgtctaaaccaaacaacataaccatcacgattccgatcagtgcagcgattgctgtcgtgcccaacaaagtagccaacacagtaaagctgatttttttgattttttcgctttctttcatcttggtaaatgccccgacgatcgaaacaaaaaccaatggcatgatcaacatttgcagcagtgctacatagccgttccccaccattgtgatccactctagtgattgggtgatcacttccgagccagttccaaagatcgcctgtaagataccaccaaaaagtatcccgacaaacaacgctgtaaacactcgtgtagagaatttcagatgacgcttttgcatcaggtagaacccataaataagggcagcaaaaataagtacaacaataactataaacagatttgtcattagtctcctcctttaacattaagtaaaatgacaaagtctgtcagtggaagtaaaggttcccagtgaccattcttcaacagttcactctaatgagacgtgtggcatcattagtgactgttttattttatagaaagaatggcgatcttacaattaataagtttcacatttttctgctaaagatcataaaaatggacaaaaaaagctgtgacagcgcagctaataaacggtccatcaaacaaattggtctacctgatagaaaatgaaccgtttctatctcagtcctcgtaaaatttgttcgatcgtctcttaacatacgcccacagcttttcatttcttcattatgctaaagctcccatagggtcccaaggagctaagacttgcggctctgcttcaaaagcagcgagttgttcggccgtcaaaaattccttgcgaacaacgatttgataggtgtactcatccatccattcatcactcattacaaaaaatccattggtaccgactttttctccccagctgttttcgactttccattttgttgatttgccatcaacgatgtccacaccagtcaagaccatcgcatgggtcatcagactttcaccataatctaaacgttgagctttcgtcatcgtgaaatcgatatcgaataagtcgttcatatcatacgcatccaatgccatgattccagaatcacgggtagaagattgcccaacatcacagccaaaccagacagattctccttgttctaattgggcaatcgccaattttttgaatgtttccatatccacattcaaatatttcacttctttacctccaacaacgttccccaacatttccactgtataggacttgttataaggtttgtcagcagtaggggcgttgatgatgcttacataatcatccagatctacccctacatatttgtcataaaatgtttgcggcgtcagtccgcgatcaatatgataatttttctcttcatcacggtattcaaagtcaaacgtttctggtggagtccccaaagaagtcgctaagaaattgtagatttcttgtagcatcccttcttttgcttcttgaatagctgcttcggattgtccatccgccactaattggcgcaatgtcccagcatctttgcgcaattttttgttcaagtagttgttcaagtcacgggaattcgatgaattactgctttctggcatcactgcttttggcacgacaccatatttttgaaagatcgacacgatcatatcccattgtccgccatcttgttggggtgtttgcagcaagaaagcaaccttgcggctagataaaggctcttgtgctgttgccaagacattttcataaaaatagttggctttttcatatttatcccagaaaaaagtatggttctgtgacaattcaaagtccttcaaattaaaggcattcaacattttgtgacggaatgtgttcaatgctgcaaacatccagcagcgacctgattgtttttggtttgacactttgccagtcgtcacatcaactgaaaagactggtacattgttgacatggccttgaatcgtttctgctgaagcagtgatcccgtttttgaccacgcctctttgcagtgcattttgcttgttattttgctgatacgcttcagcaaatttttcagtagtatttttggaaatttctgacatatttctccatcctttcactttattctcttcattttactcttgtccaaatcaaataacaaccgcctgagcaaaagtctggcagatccaaacttgcgaaggcggtgtttccatttagattcagttcgcaatcatgaagatacccaagcccaataggacaaaagaaatcccttcttcaaaacgggcgtagaactgccgaacaggtctgctggctaataggatcgtcagtaaaacactgacgacgatcaacgccataaatccgagcagtgacaagtttagttcagtgattgccagtgctctcaatcctttaataaagatcccttgcagcaaatagactaacagtgtgttcttgccccatttggtaaaaaacagctgttgccgtgggacgagtcgcagaaaaccaatgatccccagcagtccaatcacaaagaacacccctcgtaatggtcctccgaacaatggatagctcagatagtcttcataaggtttcgagccaaagaccatgtacttattcatcccatggaaaagcgcaataaacaaatagataatcggcaagaaaaccagactgattttttttattcgtgttccttgtaaaaactgcatctcatttttaggaaaataaaaaccgatgataaaaaatggtagaaagacaaatgtccgctgcagtgtcagaacttgattaataaaagggaggtaaccagcaaaaatgctcagcagcacactaagcaagatggcttttctggcagtcattttctgaaaaaagacgagagaaagctgccaaaagaacatgctgagtaagaaccacaatgcccattgagggttgagcagctgaatattcaacgacgcgtcaagtccaatcacccagtaataaactgtataaaaaagttgaaaaaacacataaggaagtagaaactttttgaccagatctcgaacttttgaaccttttgtgagcggtttggcaaaataacctgctaaaaaaacaaaggctggcatatgaaaggtaaaaataaaatagtacagatcatgataaaacttgtgatcaccaatgaatggttgcaataagtggctgaaaaccactaaaatcattaataaaaattttgcattatcgaagtaagccgtcctcggggagtggctcataatgtctcctcctttattttttctaactaaaagcataccgtaatattcagtcactgcgataacaaagtgattgcaaaacagcaacgaaaaatttcagtttattactcctaatgctgcgaagtgagttccttatagagaggatgattattgattgcatgttccatctatttgtattaatatagataatacaaaggagagagcgccagtgcaattcgaaatcaaacctcaaagcaatacacccatctatcaacaattacgcgatcaaatcattcttgggatcgcaacaggcgaattagctgtcggcgaactacttccctctgtccgtcaacttgcagaagagattggcatcaacacgatgactatttctaaagcctataattcactgaaagaagacgggctgctgattaccgatcggcgcaaaggaactgctgtcgcagcgcctcgcagctttaccttctccgaagaagaatattatcaacaacagctgcagctgcaagtagcctctgcattgattcacggaaaaagcgaagcagcgatcattgccgatattcagcaatgtttagaacagttttctgaaaggaccgaattgaaatgaattacattttctttggcataaatctgatcgtcattttttctatcgcttttacaatgaatctgctcagtaagccccacaaaaacgtattattggaaaatacattatctcctgatcacttgcagcatccggacgttttggcgttagttgctgaataccgccgccgtattatgcagtttgtcggtatcttaagtgtagcaagtctgatttttttgttcaatttatatggctctatcctcatgacctttttctggctgctcttgtttttgcttctgggggcaagctacgtcttacaaattcattatattggaaaaatgcacgaactaattgagcataagaactggggactccctatcgatcctgttttagtagacaccaaattgatccagcaaaaaaatagaaaactgttgccattagtcagttttcttccatcattgttattagtcattgctggtgtaatttatttccctaccgcggagaacggacccggttggctattcagcctcatcaactgcttgatctttttgcttttcctctatttatggcaagtgattcgccgcttaccagtacgtccattgacgaaggattttcaaatcaatcaacagttcaatgatttaacgaaattctattggtcccttctggtcgtcttaatgagcacgggcacactgctattgttttttgttccactgctctcgacccagttgacgggggtagttggagagttatccgctgttcttttcgtcttgttactggtcttcttgatggtcgttccttttgggctattgctgcgattacgaaaaaaacaagatcaattgttggcttctacggaacaacggtattatgatgaagaccgttattggcgttatggcgtgtacattaatccaacagatcctcgattatttgtccctgaccgcgtggggttgaatatcggtatcaacttaggcaaaaagaccggaaaaggtttagcaatcggcaccggcattctgatgatcgcgatcatggttgtcactatcgttcctttgtatcaattagattttaatcctgatgcaataagtggagagatgacagatcaatccgtacagtttgatgccccattagctagccgacaaacgattccgttggatgaaatcagaacagtcacgcttgttgatacacttccagagccaacggttcgcacaatggggatggcgacagatcattacctgacaggcaactttaacgttgctggtcaatctgcgaaactattcatggacaaacgatcgcaacccattcttcggctctcgacagccgatatcacgatctactatacgaacaaagacgcctctgagaccgtcaaactgtatgagactctggagcaaaagcttcagtaggcaataagaagatatttagcaagcaagacaaacaagcgaagcgacacctgcaattagtaaaaattgcccgagtcgcttcgcttgatttttcatgcttcttagctatcaggactgtgccatatgtcatcatccaacaagttaaaccgaataatagtctgttgctaggatagattcctctgacttttgcgacgaggagtccctgcaccgcaggagcaataatcattaatgttcggatagtgttacttgtaggagacttatggcacagtcccaaaaatcgctacattggtttcagattcttcgctagccgttcaatcatccaagacaaacgcttttcgcgtccagtgtcggtttttgcatcatagtatgcccgcgtgtaggtctttttgatagagagagacattgcttggaaatttgtataagctgcctcatgtttctttaataagcttgctacggtatagatttgttcctccgaaatctttggagactgaaccgcatcccattgaccgtttttcttggcctcttctatttttcttcgaccataatcagtcattagtccttggctttccaatgtttcagctagtgctttgtttttttctgaccacttgctgttctttctgcgcctcgcaaagtatttcttgtatgttttatcatcaatcttttgcatgacgccatcgatccagccaaaacaaagcgcttcttcaagtgcctcgtgagcctttatcgtcttaggaccgccagcttttccgatcaaaagccaaaccccttcacttgatacaccatactcttgaagccagtcacgaaattcatttctatttgtaaatgtaatgctgttgtccatagaatccctctcatcttctttatccactttggacacctttttaaggaaactgggtcttgacttgcgcaatagtcgaatgagtcattttccaataaatcactgtggggtaggtcaacatataagcatcgtaaagcagcagacaactatcgagtctctgaaataaagtgacttccctatgtcgactgctttgcttatccaaaaaacaagtagccgcaaggagataaactgttgaatctatctataaagcaacccccctgaatttcaggggggtttgctttacccatccatcatcttttcatcaatggggacgttttatttatgactccggcagtaggactcgaacctacgacatcatgattaacagtcatgcgctactaccaactgagctatgccggaagaatctacctgtaatatagcaaatattcagataagttggcaagtgaaaaaagaaatttttgcttctttgtcttgttgttcaccttttttgacaaaaaatcccagtactcttgaaaaaatggaattgacaaacagcaggctttcaggtattctatatcttgtgttaaataacaagccgctttagctcagttggtagagcgcatccatggtaaggatgaggtcgacggttcaagcccgtcaagtggctttctcaaaacaacgttcttgggacgttgtttttttgtttgcagttagcaccgatgattttcagttgctccttatttcaacaacgaaaatgataaacggtccatgcattgcatcactatttcacactgttcattatgttcatttgaacaatcataaatatcaatgattctcaagaataacttcttagcctattatttatccagtcaccaaaactagctacgtattctatagggccttgtattattactctggcttgttctttagaaattgcctgataaaagaactgtcggttttctccatcgtatacattgttatattgattcaacaaatcattttttaaattttcaactaacctcatactagagattggaatattaatgacgagtattgaacccgttttaaaatgattctcgttttcaaaaaagttagtaacagggttctcaactgactgacctataaaacgatacacttcggatttcaaaaatttccattgtccaccaatcttttgcccttttaatttaccatcagacaagtagtttctaatagttcttgtagttactcccaatgcatccgcaacttcagatacacttagcaaatcgtgattcatagtttatctccttacattaataattttgttcgcgtatttcttgaatgatttatcatgggttgtatataaaataattttctcttgtgatttgattgtaatgaaattcaatattgcatttgcagattctttatctatattactaatgctttcatctaaaatatataattctgcatcagatataattaatctacatactgcaattctttgtttttctcctccagataaattcgcaccattttctaataatacactatcccaatgcttttctttaaatatcggacttaaaataccagatgtttcaatcaaatatttttcatctctggttagttttcttcccattcctatattgttttctaatgacgtagacaaaatcgttggatcttgtgaaatataagcaattttattccttaaacttgaattttccaagctgttaatttctaatccattgatctttattcctttagattttctaaatttcaacatcagtctcaatagagaagtttttccactaccagaatctccttctatataaactatatcccctttattcactacttcttttaaattataattaaaaatttgtttatttattaaaaatgatgggaaattaaactcaatattgtttatattttgtatttttatttccccattttcttcacgtaataagtcaagattattcttaatgaactcattagaaatagttaaagatttataatctacatttgccttagataaatcacttaaagcggaataatacattggaataacaatacttagaataattaaatttcccacaggaaattcattttgaacaattaatatactcgcccaaatataagtcatattttgaaccaattgattaataaagacaatagcattactagtaacttgtgcatatttattattatttgctaatgaatcatacattgcaatcatctttggtttaagcagatgttctaatgcagatagagagtgtaaaatattttgtgtaaatagaaaaaaggaagtcccttctgtagaatagagttaccacaacacattcacagaaaagaggacttccctatgaacgattttactacagaaattctaaagactctagcgaacaaaggcgatttgaatgaattattccgtgtccatttggagaaagcagtcaatacgcttctcaaaacggagttatatgatttccccttggccatacgcaagagtatttattctacgaacttgattgaatcctttaataagcaaatcaagaaatacagccaccgcaaggaacagttccaaaacgaagagtcgatggaacgtttcttagtctcgtcttttgatacttacaaccaaaaattcctaggtcgcagtcataaaggctttcaacaggccgaaggcgaacttgaacaaatgctaagccaactgattgagaattagaaacaatctgcagtagggaagaatcatttacacaaaattattgacgctccccaataggtaactgtacttaataattgtttcgtttcagagatagacaaaattatcgaagtaactatcattaaaaaggagagcatcatggatttatggaagttgtttctgacagagaggcaagaacaaaaattaaacttgttagaggatattatttcaaagactgaaacatcaattgatgaactagcttgtaagcattcgctgactaatcgcaaggtgaagtcattgattatgcagatcaatgaggattacatagtagaactgaatataaccgactcactctttaaatttgaaaatagattatttagactttctgacatagagaccccagaaacttttacgtctttgtattcaagtttaaagatacagtatattagacaaagttctgttttccaagtcctgaattactttcttaaacatcgaaaagtagggatggtcaagttatcaatgcaatttaattatagtcagtcttattgttacaaattagtcaataaagcaaccgatatcattcgaacgattggagtcgattgccagattaggaagaaaatgaattatttagttgtggaaggtaaggaaagccagatacgagtactttcctatattctgaatacacattcttcgacatttgctgaggacaattattatagatatcataacgaaaagaatgtaacgaggatcaagcaagagaaactttctagaataactagagtttttatggatgcccataaaataggaagttatactgatatagattcaaaagaagagacggctataagcgactgtttatatgaagaaatccgactaggattttgtcagactttttatccgttagataaaaagatcaatcattctatttatcagtcagaaaaattcttttactatcttttcgctatttatttctttccagaatatttgacatctgaaatctgcgaacgattggagaagcgattaatgaaattatctggaaagcctatcgtagatcatgcatgtgaagctttgaagaaaatggaggagagttacagtattcctgccaaccttcatagcacatttgtttttcatcttgtatatcgttttttgatcacggataagctgagtttaagttccttcttttaccacgaagataagaaattgttgttgaacgataagtttctaaaaataaaagagatgataaaatcagtttacaaaaaaagcatagcggaaagagatttggatatatttagtacacaactaacagagctactatactcctatgttggacatgtgatggcggaacctttgaatgtcatgattaatattacctctcatgccaactatgtaatgttagtaaaaaattatataacaggtgtatataaaaaggaaactgtaactatggtagaaaaccttgcagaagcagatatcgttatttctgatcgatttgttgaatcaaaaaagaatcagtgttttttctttcttgaggatatccataacagtgaaacatggaaaaggttagggatatttatcaatgggaggatcatcgaacggcgaattcgatctgaaagtgccccccaaaaattagttaggatcgatctgttgattgagtcatggcacagatgcttttacttaaagattgtttgtttcgcaggggcaacgataaataagtcaaaaaaatatatctataaaagagggctgtgacagtcatcttttatagatatttttttatagtgatttcattggtattaggtttgcgaagaaagcgatttttggatagaaatttctacaatatctggcatttcaataactgagatcgtttcaggttcataagaaccaggcggtaattttttcaagaagtaatgtttgatttcttcaatttcggtaggtttgattgcacgttttttgttgatcagcaatatttcgttgtgatttggggcagaagtaaagatgactgtgatgtctccggcagtatatacttttaccatttcagcatcggtattttcaagctgattcataactaatcgagaatggctgtttgtcacattgatcaatttcaccatactcacctcacattctatgtatttttactaatattatagggcgttttttttaaaaagaaaagccagacagcttgaaaaccttggtttttttgaggttattcaggcgtctggcatagaaatctagacaaataaggtacgatgtctggctgttgcgaggattttactcatcatcagatggctgtttttcttgttcctttggctcttctggtgtgtcaacagtttttgctgtcacaatgattttgtcttcagaatccaaagttgcttgtagatcatggacttgtggatgatcaagataaaattctgcgataccatcttcgatatgatcttgaatcgttcggcgtaatgggcgagcccccatcgtagcactataaccaagctctaccaatttttcttggacattttctggaacttcaatatgcaatttttgattggctaaggtttgattgacatctgcgagcatcaaagaaacgatggataacagattttctttgcttaatgctttgaattcaatgatgccatcaaagcgattcagaaattctggtgtgaagtagttatttaactgattcaagacagatcgtgtgacaccttcccgggctgctccaaaaccaacattggcttctacttttccagtgccagcattacttgtcatgatgatcaatgtgtctttgaagctgaccgtgcgtccttgagcatcagttaaacgaccgtcatccaagatttgcaaaaacatatgcagaacatcaggatgagctttttcgatttcatctaaaagaattaagctataagggttacgacggactttttccgttaactgtccagcttcttcataaccaacataaccaggaggagaaccaatcagtttggagacactgtgtttttccatgtattctgacatgtcaaaacgaatcattgattcttcagagccaaacatttcataggcaagttgtttagcaagttctgttttaccaacaccagttggtccgacaaaaaggaacgaaccgatcggacggctttgttttcctaatcccacacgattacgacggatcgctttagcaactttatcgattgcttcatcttgtccgattacatgcgatttcagatcttgagctaagtttttcaactgagtttgttctttttctttgagttcgccaaccggaatgcccgtccgttcttcaacgatttgctccatatccttttcggtgatcacgggagtttcttcttcactgatttgacgttctttcattttttgcagcttattgatttgatctcggtagtaagcagctttttcaaagtcttcttctctagaagcagcttgtttttgttcttctgcttcttgcaatttcttgtcgattgttttcggatcaacaatttgaatagtcagattttttttcgagccggtctcatccagaagatcgattgctttatcaggcaagaaacggtcttggatgtagcgattggaaagggtagcagcggctttgattgcctcatccgtatatcttacatgatggtaatcttcatatcgaggctgtaatcctttcaaaatactgatggtttcttctacagaaggttcatcgactcggacaggttgcaaacgacgttctaatgctgcatctttttcaatgatgcgatattcgttcaatgtcgttgcgccgaccatttgtaattcaccgcgagccaatgctggtttcagaatatttccagcgtccatgttgccatcaccagcagcccctgcgcccacgatctcatggacttcatcaatgaataagatgacattttcggcttgtttgatttcttcaatcaatttttggattcgctcttcaaattgtccgcgaatacccgttccttgaaccagtgacgcaacatctaagcgaatcacttctttatccattagtttttgaggaacgtcaccgtcgacaattttttgtgccagaccttccacgacagcggttttacctacaccaggctcaccaatcaatacaggattgtttttcgttcggcgattcaagatctcgatcacccgacgaatttcatcgtcacgtcctacgactggatcgatcccgccgtctcgagcttgttgtgtgatattgatgccgtattcgcctaaaagaccagaaggtgcttggccattgcgcggaggttgtccgccgattatgccgtttcctccagtttgagttggaggcgtttgttcataaggtgaatttccttgttgcatttggcgagacatttgtcgaaaaaggtcatcaagatttccgaagccgaagggatcctgagccatcatatttgttggatttccagattgtgcttttaatttttggtaacaactttgacaataatcgagttgttttctttgaccattgacattggcataaagatgaatagaagcttcatttttaccgcagttttgacaaagcatatgttcacgacctttcttatcatttgctcatctatcattctaccgcgatttttactcatggtaaaaagatacacttgcagattcggtgaataattgtcagcagcgtcaaaaatttcattgacctttactgaccataactttattatacaatttttttttcagactgcaaggatttcagctttgatgacggaaacaacttttccctgaaaaaagaatcgtttataatggagaagatgaagaggtgatagagatgaatgaaaatcgatttgttgaacaaattgaacagttgcgctctggagaaatcgacgaattgctggtagaacaatccgaatttctgctatttcgagaagcatggttaaaattggaagaccgcatgaaatttgtcggcgaggctggcttgaatggcaagatcatctatcggtaccaaccataaaaacaaatataggttcatttcagtcgttttcttaagagaaaacggttgtctatcagagaaaaaaatggtaatcttaacagttgaaagggcgtttttttgagtctgacaattgactgagtcaaaaaaagccttcaccacaaaaaaaccgtatcataaaggagattgatcaatatggaaaagaaagattttcacgtagttgctgagacagggattcacgcacgtccagctactttattagtacaaacagcaagcaaattcaactctgatatcaacttggagtacaaaggtaaatcagtaaaccttaaatcaatcatgggcgttatgtctctaggtgttggtcaaggttctgacgttacaatcactgctgaaggtgctgacgaagcagatgcaatcgctgcaatcgttgaaacaatgaaaaaagaaggtttgtctgaataatggttgagatgctaaaaggaattgctgctagtgatggtgtagccgttgccaaagcctacctgttagtacaacctgatttatctttttcaaaagtaaatgttgaagatacggcagcagaagaagctcgtttagatgaagctctagcaaagtcaacagcggaattgcaacaaatccgtgacaaagcagcgcaatctttaggcgaggcagaagcacaagtatttgatgctcatttaatggttctgtcagatcctgaaatgatcggacaaatcaaacaaaacatggcagataacaaagtcaatgcagaagctgcattgaaagaagtcactgacatgtatatcggcatgtttgaagcaatggatgacaatgcatacatgcaagaacgtgcagcggacatcaaagacgttgcgaaacgtatcttggcacatttgctaaatgtgacgttgccaaatccttcaatgatcaacgaagaagttgttatcgttgctcacgatttgacaccaagtgatactgcgcaattagaccgcaacttcgttaaagcttttgtaactgatatcgggggacgtacctctcactcagcaatcatggctcgatctcttgagattcctgcaatcgtaggatcaaaagaaatcacagctaaagtgaatgctggtgatattctggcagttaacggaatcttaggagatgttatcatcaatcctactgaagaccaagctgctgaatttattgaagcagggaaagcttacgcggaacaaaaagcagaatgggaaaaattgaaagatgctcaaaccgttacagctgacggcaagcactttgaattagctgcaaatatcggaacgcctaaagatcttgaaggtgttcacaacaatggtgcagaagctgtcggtttataccggacagaattcttgtacatggattctcctgattttcctacagaagatgaccaatatgaagcatacaaagcagttcttgaaggaatggctggtaaaccagtcgttgttcgtacaatggacatcggtggggacaaagaacttccttacttgaaattgccacacgaaatgaacccattcttaggctatcgtgcattgcgtatcagtttatctgagttgggtgacggcatgttccgtacacaacttcgtgcgctgttacgtgcttctgctcacggaaacttgcgtattatgttcccgatggtggcaacattgaaagagttccgtactgcgaaaaaaatgtacgaagaagaacgtcaaaaattgatcgatgaaggcgtaactgtctctgaagatattcaagtaggtatcatgatcgaaattcctgcagcagctgtcttagctgacaaatttgccaaggaagtagacttcttcagtattggtaccaatgacttgatccaatacacaatggctgcagaccgtatgaatgaacaagtttcatatctttaccaaccatataacccatctattctacgtttgatcaaaaacgtaatcgattcagcacatgctgaaggtaaatgggctggtatgtgtggagaaatggctggcgatcaaactgctgtgccacttctagtcggtatgggcttagatgaattctctatgagcgcaacttctgtacttaaaacacggagcttaatgaaacgcttgtcaacaactgacatgcaagaattagcaaaacgtgctttggaagattgcgatacgatggaagaagtagtcgaattgatcaatcaatatgtaaagtagttaaaagttagcagcaagcgaattcgcttgctgctttttttgtggtctgggagcgaacagttttgtcatattgttttgatgacctttgataaaccagctttttgacgtatgatagaaatcaatacaaaaactaggccttgagttggagggtgttctcgtctagctatgttatactagatgtaacagtttagaaggaggaatctcgtttgaaagtacttctctattttgaaagtgaaaagcttttagagaaatctggtatcggcagagcacttgcgcatcagcaacgtgcactgagcagtatcggtgttgaatatacattagacaaacaagctgaggattatgatatacttcatattaatacgtatgggatcaattcgttgaatcaaatcaataaagcaaggaaacaaggcaaaaaggtaatttaccatgcgcattcgactgaagaagattttcgaaattcatttatcggctcaaaccagttatcgccattatacaaaaaatatttgatcaatttatattcccgagccgatcaattgataaccccaacgccctacgcaaaagaactattggaagggtatggcatcaaggtaccgatctgtgcgatctctaatgggattgatttggacaaatatcgtccggaaccaaaaaaagaacaggcttttcgcgactatttccaattgtcggcggatcaaaaagtgattatttctgttggcttgtattttgagagaaaaggaattgtcgattttgttgagattgctcgccgcatgccagagtatacttttatttggtttggacatacacctatgtatacgatccctaaagcggttcgagatctcgtgaaagaaaaccatcctgaaaatgttatttttcctggctatatcaaaggagatgtcattgagggggcctattctggagcagatctgtttttctttccttcctatgaagaaacagaagggatcgttgtgttagaggcgcttgctagtaagcagaaagttctagtgcgtgacattcctgtttatcatggttggttgcaagagaatcaaaattcttatatgggacggacagttgatgagttcgttgaacaaattgctaacatcgtagaaggtcgtgtaccagatctgtcagctgccggctatcaagcagctgcagaacggagtattgaagaaattggaaaagagttaaagaaagtttatcaaagcgttttagaagaaaaacccgttgattgacggcaagtttggaggtaccgttgtgaaaatcggattttttacagacacatattttccgcaagtgagcggtgtagcgacatcgatcaaaacattaaaagaagagttggaaaagaagggccataaggtctatatctttacgactacagatccaaatgcagaaatggatgaggaagatatcattcgtatgcctagtgtgcctttcgtgtctttcaaagaccgtagaatcgtggtgcggggcatgtggtatgcctatttgattgcgaaagagttggaactagaactgattcatacccatactgaatttggtgcgggactactgggaaaaatggtgggtcgaaaactacagattcctgtgattcatacctatcatacaatgtatgaagattatctgcattatattgcgaaaggaaaagttttgcgacctacacacgtaaagtatttctctcgtctgtttgccaatcattctactggggttgtctgcccgagtgaacgggtcatcgatacactacgcagttatggcgttgtgtcgccgatgcgcatcattcccactggtattgaggtagagaaatttcgccgtccggatatcactctggaaatgaaacgagccttgcgtcaagaattggcgattgaagaagaccagccaatgttattatcattgagtcgtatttcttatgagaaaaatatccaagcgatcgttgatggactgcctgatattctagcagaaattccttcagccaaattagtgatcgtgggcaaagggccttacaaagaaaaattggaagaaaaagttcaagaaatgaacttgtctgaccatgttcattttgttggagaggttgcaaatgatgaagtagccatctattatcatgcagcagatttcttcgtcagtgcttctacttcagagacacaaggactgacgtatacagaagcaatggcagcaggtacgcctttagtcgttgaaggcaatgattatttaaatacattgatcgatgatccatctcttggtgtgacctttgacaccgatcaagattttgcttctgcatttattcattattatcaacagcagattcctaggaatgaaagtgtcttagcacgaaaaatgtatgaaatctctgcggcacactttggtgaatcgatgctttctttttaccatgatatgattgcttactatgagacagaacgcctagacaaggaaaccgaagaaacattgaaaaaattcaaagtcaaattgaaatcatttaaacgaacaattgattaaacattattgcagtcaagttcacgtttttagcgtatactaaagacgtgaatttttttatttttggaggtatgactatgaagctaggttttattggaacgggtgtcatgggccaatcaatggtcggtcactttttagcaagcggacatcatgtaaatgtgtataatcgtacaaaaagcaaaacagacgaattagtcgctaagggagcggtttggtgtgatacgcctgaaatagttgctgctgaaagtgaagttgttttcacaatggtcggctatcctgcagatgttgaggaagtttactatggagaaaagggaatttttcaaaccgatgtcgcggcaaaatatttagttgactttacaactagtacgccaaaattagcagaacaaatctatcaaacggcaaaagagcatggtgcggcaagtattgatgcgccagtttctggtggtgaccttggagcaaaaaatggaacgttgacgataatggcgggtggtgacgaggaagcctatcaaaaagttgaaccactatttgagattgtcggaaaaacgtgtcatcttcatggctctgccggcaaaggccagcacacaaaaatggccaatcagatcatgattgctggcacgatgactggaatgactgagatgctcgtctatgccgataaagcaggtttagaacttccgcaagtcattgagacattatctggtggcagcgccgcaaactggtcattggccaactacagcccccgtattttgaaagaagatttttcacctggtttttttgtcaaacattttatcaaagatttaggtatcgcacttgatgaagcagcgaaaatgggactggatttgccaagtacggctttggcaaaaaaaatgtacgatcgcttagcggaagctggctatgaaagtgatgggactcaagccctgattaagctttggtggcaagatggaaaaaaatcttaaaatgacaaaataaattgtaaaaaatcaatgcaagatagaatatgatttgatacaatataacggacagaaaaaggaggcttacgaatgaaaagttcgcaattagtcgctatcatcaaacgtttagaagcgatggtcgaagcgcaagacaacgaggttcaagttcgccgtttcgaaaaagaaggcgtagaaaaatgcacagtgacctacgataacaccacagaaacgtttgagttaacggaagcagagtcaagtcagccttatcaatttgataatattgatattgtagccatggaaatttatgatttgatccaataaacgtatcagcgttcagatgaaaaatgccatacgcattgccagcgttcctctttaaggagcgctggttttttgttgcaatcatttgagcgtttaggtatttgacagcacaaaatttaattgtcttaactggcgcaaaattatatgtagagggtcaaggtctgttggcagcaatcgtttagctgttgttaaaggtgctggaacaaaagcatcagaggttgatacaacttcgctatgaatgatttgtccaaaagagagttgatagacttttacttgtgatgaatcggcagcaagagaagcttcaagagaggtttcaagaggaatctcaaagcgaaattctgggagagcgatcagagtattcacctcgagaatttctcgataaaaggattgaagcaattttttttggtacagtagttgaccagcctgttcaaaaagtaactgttccgcaaaataatgcaatcgttggtcgagataacgaaatattgtcttgctttctgcacgaaagaaaagtttcagctcattcagtttttcttccaaaggaatagtttgcattaacggcaactgtttggacaacgagagaagtttataaggattgacagaaggtaattgatacgtttctgtcaatatctcaatgatttccggcaattgcttggatcggcgaaaaggtcctagtgcatcctctgctgcctcatttgttcgaacgatgtttcctgcatcaaagcggatgtattggtaattaagaaagttggtcatttgacggttataaatgggacgatgttgctgaatcaactgacattctaacaatagcgcatcgagttctgtgtctacgaaaattgtttcgaaatctacgacattgtgaactaaacgcagaatcttgtttgtatgctgtgtatttttgcgaaaataagaagaaactcgttgtttcaattgcttggcttttccaacatacagaattccgccatgagaatctttcattaaataaatcccaggtttttggggtaacgcatttgctttttgctttaagtattcgatccgtgcgttgatgtccatcacctcgtttctacactgcaacgataccaaaaattaaggtgtagaacaagtgatgttctgacacgataatcattttcgtgaaatgatggaagaaatctttgataatcaaaataatttttaactactcgattctctggtaattgtcaacttaaaaacttgtgaaggttagaaaagcgtactgaaaataaaaatgcgcttaaaaaaaataaaaatcaaaaaattttcttgcaattctctaaaagttactttatagtttgactatcaaatgatttgattatcaaactattcggatggtgaaagatatggaaccaaatttagaaacggtcaacgactatttagtcagtgtcttcaatgacattctcgtgatcgaagaatcagaattaaagaaatcacaatttaaagatctttcaatcacagaaatgcatacgattgaagcaatcggcatgtacaagaagaaaacaacttcagaagtcgctaaagagctttctattactgttgggaccctcaccattgcaatcaatcgtttggttaaaaaagaatatgtagaacgcattcgcagtgaagacgatcgacgcgtagtcaaacttgcgttgacaaaaaaaggcaaattgctttatcgggtacatcaacattttcaccgtgagatggtcaaaggcgttctaagccagatgtctacggatgaagagcaagctttacttaaagccttaaaaaatctgcatgactttttacaagattataagtgagtgtaacggatgaatatgtttggaaagattaccgcaacagcaagctatgttcctgaacaaatcgtgacgaatcagcaactttcagaaattatggatacatcagatgactggattttttcacgtacaggaatcaaagaacgtcgaattagtaatggagaaaatacttccgatttatgtacgaatgttgctacgaaacttttggcatcaaggggacttgctccagatgaattggactttatcctagtagcgaccatcactccggatttcaatacaccggcagttgcttgccaagttcaagggaatattggcgcccatcaagcttttgcttttgatatcagcgcagcttgtgccggatttgtttatgcattgtctttagcagaaaaattgattcggaccggttctaaaaaagggctcgtcattggcggtgaagtgctgtcaaaggtcttggattgggaagatcgttcaaccgcagttttatttggagacggggcaggcggggtgcttttagaagcaaccaaccatcagcatctcttgaaggaatcgatgcagtctgatggaaccagaggactctctctgacatcaggttttgttgaaaataagaatccttacggaagttcgtcaatccaatacagtgcttgtatgcagatggttggtcgtgaaatttttgattttgcgacacgcgatgtcgttcaatccattcatgcaatcagtgagcatgaatcggtagattattacttgttgcatcaggccaattcccgaatcttagataaagtggctcggaaattaaaggtcccgcgacataagtttttgcaaaatatgcaattttatggcaatacttcagccgcttcaattccgattttgttagatgaagaagtgaaacgcggcacgctgtctttaggcagcggacaaaaagtggtgttctcaggtttcggcggcggattagcatgggggaccatgctggcagctttatagcctgttcacaatcaatattgaagaaaacacattggaggaatatacacatggtattcgaaaaaattcaagaaatcgtagcagaagaattaggaaaagaaaaagaagaaatcaaattaaacacaaacattcaagaggatcttgaagcagacagcttagaccttttccaaatcattaacgagatcgaagatgaattcgatgtaaaaatcgaaactgaagacggcatcaaaactgtcgaagatctagttaaatacgttgaaaaacaacaagcataaaaaacgaggctaggcaaacagcctagcctttccttgtaatagaaagagtgtgtttcactcgctgagatctgcgagtgaagatgccattttctccaaaatctttcagttcaaaaaaggagtttaaaatgaaaacagcatttttattcagcggtcaaggagcccaatatgtaggaatgggtcaggagttatatcagcaagaatcaagtgttcaacaaacctttacggaagcaagtgagatgctcggctatgatatgactgaactatgttttactgaaaatgaccgtttgaatcaaactgaatatacgcagccagccattttaaccgtcagtgtggctttttggcgtttgttaaaagaaaaaggtctccaggccgatgctttggctggtttgagcttaggtgaatattccgcattagtagcaagcggcgcattagactttcaaactgctgtagccctcgtgcaaaaacgcggcaagtttatggcaaatgccgcaccacagggtgtgggtaaaatggtcgctgtgatgaatactccggctgaaaccattgaggcgatttgtaaagaagctagccaagtagggatcgtttcgccagctaattacaatacgccgcagcaaattgtcatcggtggggaagtagctgcggttgaccaagccgttcagttattgcaagcggcgggagccaaacgaatgattccattaaatgtcagcggccctttccatacaaaacttttagaacccgcttctaaacaacttgctcaagagctggcgaaaattgaaatcaaagatttacaggtgccggtgatcagcaacacgactgcgaaaccgatgaaacaagaacaagtcaaagaattattagagaagcaagtcaaatcacctgtgcgtttttatgaaagcatcgagcagttgaaacaaatgggaattgagcagatgatcgagatcggtcccggaaaagtattgaccggttttttgaaaaaaatcgacaaaaccattgctgcttcgagagtggaagatgctcaaacactttttgacacactttcaaggtttgattaggaggaatttatggaactgacaaataaaaatgtctttattactggtagttcaagagggattggctttggcattgcagaagcatttgccaaagaaggagccaatatcgtattgaatgggcggaaagagatacctcaaactcttatagagacgattacccgttttggtgtgaaatgcatcgcagtcaacggtgatatatccgaatacgatcaagctgtttcgatgcttgcacaagcggaagctgaattaggaccgatccacattttagtcaacaacgcaggaatcaccaatgacaagttattgttgcgcatgaaaccagaagaatttgaaagtgtattgaagatcaatttgactggaaccttcaacatgacgcaagtagctctcaaaaagatgatgaaactacgcgaaggacgtatcattaatttgactagtgtcgtaggattgactggcaacattggtcaagcaaattatgcagcaagtaaagctggcgtgattggttttaccaaatcagttgcccgcgaaggagcggctagaggcattacctgtaatgcgatcgcaccaggatttattgaaacggagatgaccgcagttctttctgataaggtaaaagaacaatcgatcaataatattccgttgcagcgatttggtgctgtagaagatgtcgcaaaagctgcggtttttttggcccaaagcgcttatatcacaggtcaagtagtcagcgtagatggcggaatggccatgcaaggatagaaaggagatacttatgaatcgagtagttattacaggatacggtgtgacttccccaatagggaatgatccagaaacatttttagctagtttgcaaaatggaaccaatgggattggccccattaccaaatttgacgccagtggaacagggatttcagtagcagctgaagtcaaagagtttccactagaaaaatactttgtcaaaaaagatacgaaacggatggatcttttttcgatttatgggatctatgctgcccttgaagcaatgaaaatggcgggtttgaattctgaagcgttagatgccgatcgattcggtgtcatggtcggatcaggtattggaggtttgccaactattcaagaccaagtgattcgaatgcatgaaaaaggtgcaaatcgtgtgtctccaatgtttgtgcccatgtcgatcgtcaacatggtggcaggaaacattgcattgcgtgtgggggcaaaaggtatttgtacaactacggtctctgcttgtgcatccggtactcattcgattggtgaggctttccgcaatatcaaacatggttatgcagacgtgatgattgctggcggatctgaatcaacgatttgtgagattggtatcgctggttttgcttctttaacggcattaacaacggaatctgatccagacaaagcatccacaccatttgacaaaaaccgcagcgggtttgttatgggagaaggtgctggggttttgattctagaatcatttgaacatgcccaaaagcgcggagcgaagattctcggggaagttgttggctatggtgccaattgtgatgcctaccatatgactgcaccgaatcctgacggttcaggtgctggaaaagcaatgaaactcgcgatgtctgaagcagcgatcactccagccgaagtaggctatatcaatgctcacggaacaagcacaccagctaatgatgtagctgaagctacatcgatccaatatggtttaggggacgactatcgcaaaccttacgtcagcagtacaaaatctatgacaggacatctattgggggcagcaggaggaatcgaagcaattgcctcgcttttagccttgcagcatcaatttattccaccgaccatcaatgttcgtgaacaagatcctgaaatcgacttaaatattgtgaaaaaccaaagccagccagcagaaattacgtatgcaatgagtaactcactaggttttggtggacacaatgcagtcatcttattgaaacgttgggaggaagcttaattggaaacaaatgaaatcaaggatctgctttcccaatttgatcagtcctctttgactgaattgcagctcaaaaaagaaaacatcgaactttattttaataaaaattcgttcagtagccgtcaaggttcatccgagagttcagatgtcaaagttgaaagcatccctgcagctgcaccagtaccaagcgtacaaccaacagctgctggaaccctcgaggttagttcagagccaattatagcgggaacggagatcgtttcacctttagtgggtgtggtttacttaaaacctagtcctgaacaaagccaattcaaacaaatcggcgattctgtcaaaaaaggggatgtcctttgtatcgttgaagcaatgaaagtaatgaatgaaattgttagcgatgttgatggcgaattagttgaaatcttagttgaaaatgagcagatcgttgaatacgatcaaccattattccgtgtgaaagaagggtaagctatgtcagttatgtcaattcaagaaatcaaagaaatcattccccatcgctatcctatgctcttagtggatcgcattgaagaactagaagaaggaaaacgggtggtagcaaagaagaacgtgaccatcaacgaacctttttttcaaggccattttcctcatgaaccagtcatgcctggtgtattgatcgttgaagcaatggcccaagcgggggcagttgcactcttgtctttaccggattttcgaggtaaaaccgcttatttcggcggacttgataaagcaaaattccgcaaaaaagtaacaccaggagatacattgatcttagaagtagaaatactcaaggtaaaatctgcagcaggaatcggcaaagggattgcctatgttgatggcaaaaaagttgcagaagcagaacttaccttcatgattggataggtgaaaaatgttttctaaagtattgatagctaaccgtggtgagatcgctgttcgcattatacgtgcttgccgcgaacttgggatccaaacggtcgcagtttattcagaagcagataaagaagcgttacatgcagaacttgccgatgaagccatttgtattggcccggcgaaagcagcagactcttatttgaatgtgcaacaaatattaagcgccgcgatcgttaccaaagctgaagccatccatcccggatttggtttcttatcagaaaatagccgttttgcatctatgtgtgaagaatgcaatattgtctttattggtcctaagagtgaaacaatcgatgcaatggggaacaaaatcaatgcccgacggttgatgatcgaagcacaagtgccagtgatccccggcagtcaaggagcgatttctgatgtgaaagaagcattgacgatcgctgaagaaattggctatccagtgatgcttaaagcagcagcaggcggtggtggtaaaggcatacgtaaagtattgacaaaagaagaattgccgcagcatttttcttccgctcagcaagaagcaaaagccgcttttggtaatgatgaaatgtatattgagaaaatcgtgtatcccgcaagacatatcgaagtccaagttttaggagattcttttgggaatatcattcacttgggcgagcgggattgttctttacaacggaacaatcaaaaagttttggaagaatcgccatcggtcgtaatatcagctagtaaacgtcaagaactaggagctgcagcagttcgcgccgctcaggctgttggctatcgcaatgctggtacaatcgaatttctgatggatgaagctggcgaattctatttcatggaaatgaatactcgcatccaggtcgaacatccgatcacagaaatggtgaccaatatcgatctcgtaaaaaaacaaattgagattgctagcggcgaaccgctggatatcaaacaagaagatatcaaaatgcaaggtgctgccatcgagtgtcgtatcaatgcggaaaatccagcctttaattttgctccttcccctggaaaaattcacaatttgtttttacctggaggaggtctgggcgttcgtgtggatagtgccatgtactctggatatacgattcctccttactatgattcgatgattgcaaaggtcatcgttcatggagaaaatcgatttgaagcattgatgaaaatgcagcgagctttggctgaattagtgactgagggtgtagtgacgaatgcagaattccaaatggatctgatcggtcatccaaaagtgattgccggagactacaacacagcctttttacaagaggaattcttgccaaactggacgcctgaacaataggagggaagagaatggctttatttaaaaagaagaattacattcgcatcaatcctaatcgcggccaggcacctgccaatgaaccaacagtgcccgacaatctttgggcgaaatgtcccagatgtaaacggaccttatatacaaaagaaatgggcgcagaaaaagtctgtcctcattgcggctataatttccgtatcagtgcctgggaaagaatcgcattaacgatcgacgaaaaaagcttggaagaatgggatacagatgtgaaaatagaagatcctctcaactttcctgattatctcgaaaaaatagcttccgtacaggaaaaaactggtctccatgaagccgtgttaactggagaagcgacaatcaatcagcaacctgtggcaataggaatcatggattccaactttattatgggaagtatgggaactgtcgtaggtgaaaaaatcactcgattgtttgagcgagcgcttgcgaagaacttacccgttgtattattcactgcttctggtggtgcacggatgcaagaagggattttttcattgatgcagatggctaaaatctctgcagcagtgaagcgtcatagtgaagccggtttattttatttgacagtcttgacagatccaactaccggaggcgtaacagcaagttttgcaatggaaggagatgtgattctcgctgaaccgcaggcattgattgggtttgcggggagacgagtgatcgaacaaacgattcgacaagaactgccagaagacttccaaaaagcagagttcttgttggaacatggttttgtcgatcaaatcgttccacggacacaattaagggaacgaatttcccaattgcttaaattgcatacgacaaaggggtggatgacaaatgattgaagcggcacatgagatcgttgagttagcccgcagcaaagatcgtttgacggcacttgattactttgaacatgtttttagcgattttcaggaattccatggggatcgtctctatgccgatgatgaagctgttgtgggcggggtcgctgccttagatgggaaacctgtgacagtgatcggtatccaaaaagggcggaacctgccagagaaccttcgacgaaattttggtgctcctcatccagaaggttaccgaaaagcgttgcggctaatgaaacaagcggagaaatttcaacggcctgttatcacattgatcaatacagcaggtgcctattgcggcgtcggcgctgaagagcgtggcgaaggagaagcgattgcgcgcaatctcttagaaatgtcagatttaaaagtaccaatcttggcaatcattattggcgaaggcggcagtggtggagctttggcattggctttaggggatgaagtatggatgatggaacattctatctatgcgattttatccccggaaggctttgcatcgatcctctggaaagatggaagccgtgcgaaagaagctgccggactcatgaaaataacagcgcaagagttgcacaagcttggagtgatcgaaaaagtgattcccgagaccatcgacggtgaactgttgtcgaaagagacagtgatcgcggaaatgcgatcggcaatcaccaaaaagatcgctgctctagcacaaaagaatatagaccaactccttgctgagcgctatcagcgttttcgcaaattttaatcataagtttgatatcaatgtcgatttttgatccgtcattgatttcaagcttttttatttgtccttgtgaaatttctctaatataataaacatcagcagatagttgtttgaaattcaataacattgtggtattatgtatatattctgaataaagatgggaatatatgcataattatttattttataaggggagaaaacaaatgaagaaattgatgagtggatttataacagttgctgctttattaactttagctgcatgtgggaatggtggatcatcaagcactgattcgtcaaaaaaaggagatcaaaatcagctagaagctatcaagtctgctggtgtattaaatgtagcgacatcagctgattttgcaccttttgagttccatgctttgattgatggcaaagaccaaatcgtcggcgcggacattgatctggtaaatgaaatcgccaaagaattaggcgtcaaagtcaatgtaatggacttagagttcaatgctgttctaactgcattgagccaaggaaaagcggatattgcggtttctgggatctcagcaactgatgaaagaaaacaaacatttgattttactgacaactactttacacctgaacaaaaaatcgtgatcaaaaaggacaatacggatgcattgtctgcaatcgatgacttttcaggaaagaaggtaggcgcccaaaaaggatcgatccaagaggctgtggttcaaaaccaattagctgactcacaattggtttcgattgcgaaagtgcctaacttgatcaatgaattgaaacaaggatcgatcgatgggctagtacttgaaagtgccgttgcagactcatatgttgctcaaaatgatgatttggcagtggctgacattgctttggaagcttcaccagatgattcttatgctatcgctctaccaaaaggcagcacagaattaaaagatgaattgaaccgtattttgaaagaattgaatgataaagggacaattaatgaatacgttcaaaagaatacagacttagccaacgaaaatgcggctgaatagatcggagtagtaaatttatggatttttccttcttgtcgacttattatccttactttatctcaggggtattgattacgattgtcatctccattattacagtgatcctaggcaccatcctcggaatcacctttgcattgatgaagttatcaaaagtaaaaccattacgctggatcgctaatacgtatatcgaagtgttacggggaacaccgatgctggttcagatattgattgcatttgggttattgcaggggctgttctcactgccgacgatttcgtttggtgtgttgaatcttgactttggacgactattcccagggattatcgccctttcattgaactcaggggcttacgttgctgaaatcgttcgtggtggtatcaatgcagtcgattttggtcaatcagaagcagctggttcgctaggattgcgtcctgcacaagcgatgcggtatgttattttacctcaagctttgcgtaatatcttgcctcctctaggtaacgagttcattgttttgatcaaagactcctctttgttatccactatcggtatctacgaattgatgaatagcgcacaaattgttgtgacaagttcgtatcagccattaactcctttatatgttgccgctgtaatttactttattttaacgtttaccacctcccgcttgttgaatctatgggagaaaaaactcggcaaaggttaccggcgataggaggaaaaaagatggatacaatgatcaaagtaaagaatttacacaaaacatttggaacaaatcaggtgcttaaaggtatcaatactgaaatcaaaaaaggtgaggtcgttgttgtgattggaccttccggatcgggaaagagtacttttttacgctgcttgaatttgttagaagaaccaacaagcggcaatatttactttaaagggacggacattactgacaaaaaaaatgatatttatcaaatgcgggaaaaattaggcatggtttttcaaaactttaacctcttccccaatctgacagtaatggataatattacattgtcgccaatcaaagtaaaaaaaatgtctaaagaagacgctcggaaaatcggagagaaactgttgactgacgtagggttgccggataaagcaaaagcttatccccaaagcttatccggaggacaaatgcaacggatcgctattgctcgcgcattggcgatgcagccagaagtgatgttgtttgacgaaccaacatcggcgttagacccggaaatggtcggtgaggtattgagtgtcatgcagcgtttggctcaagaagggatgacgatggtgatcgttacccatgaaatgggatttgccaaagaggttggcgaccgcgttcttttcatggaccaaggggtcattatggaagaggggactcctgctcaaatatttgatgcaccgcaaaatccgcggacaatcgattttctggcaaaagtcttatgatcttttttagaccatgaagttggttagtgtgatgtgcgttcatatcggtcaagatgaaaaacaatgaattgtctgaacgattcttgaggaaggaagctgcagaagtaatctgcattgattgctcactcctctgatcgttcggcttttttattttttaaagaaagtagcagtggatgatccgttgcttttttcaactagatgaaaatctgttgctgagagttgtagctcagtctagtatttcacacgattctattgtataattacaggttgaaagtagcattataagtaggatgcttttaaataatcatcagtgaccctgtggggactgattgacgacttgtcagctgacaagctgtttttatctagacgtgtcaacaaattgactatttttgtcacatgaataaaagaatcaaggagaatctatgttttcaaaatttaaaccgacttggatggtcgatgccatctatcagatcactccccatcaacttaagaagcaaggcatcaaagctgttctaactgaccttgataataccctgattgcttggaatgatcctgacggtagtgaagagctaaaaaattggttgttagaaatgaagaatgcgggaatcccggtgattgtcgtttcaaacaataatagtgaacgggtcgcacgggcagtggcgccctttggtttgcaatacgtccatcgagcattgaaacctttttctcgtggcatcaagcaaggataccgccaactcggcttgcaaaaagaagatgttgtgatgatcggtgatcaaatcatgaccgacattcaaggtgctaatcgagcaggggtccgtagtatcttagtgaagccgatcattaatacggattcatggaaaacacaattcaaccgtttgctggagcgaagaattatgaagtatttattgaaacacaatccagaaatgaaatggcgaggtggaatttgataatgaatgaagaaatgattcattgtattggctgtggcgcgctgatccagacagaaaatccaacagagcttggttatacaccgctctctgcattagagaaagggttagaaaccggagaagtctattgccaacgctgtttccgcttgcgacattacaatgaaatccaagatgtctcgctgacagacgatgattttctgcgtttactgaacgaactcggtcaaaaagatgcattaatcgtaaatgtagtggatatctttgattttaacggttcgttgattccaggacttcatcgttttgtgggagacaatcctgtgttgctagtgggcaataaagtggatatcttgccaaagtcattgaagaaatcaaaaatgacccaatggatgagagagcgtgcccatgaagcagggctgcgtccaatcgatgttttattgacaagtgcaaaaaaagccgccgaaatgactgaattgttacaggcgatcgatcattatcgagaaggtcgagatgtctatgtggtaggtgttacgaatgttggtaagtcgacattgatcaatcaaatcatcaaacagacggctggagtccaagaattgattactacttctcgttttccagggacaacccttgataaaatcgaaattcctctcgacgacggtcactttttgatcgacactccagggatcatccaccgacatcagatggctcattaccttggaaagaaagatttaaaaatcgtggcgccgaataaggaaatcaaaccgaaaagctaccaattgaatgctggccaaacactctttttcggaggagtggcacgttttgactttattcaaggagagcgcagctcattcattgcttatgtagcaaatgatgtggtgctgcatcgcacgaagttagaaaaagctgatgctttttatcaaaaacatgttggtggtcttttacaaccgcctcgtcctgatgagttagctgattttccggagttagttcgctttgaattttcgatcaaagaaaaaacagatattgtttttgcaggtttaggatggatcacagtcacaaaaccaggagttgttgctggttgggcacccaaaggcgttgatgtgatcaaacggaaagcattaatttaaaggaagaaggcagaacatggaattacgaggaaaacaaaagcggtttttacgcagtgaagcgcatcatttaacaccgatttttcagattggcaaaggcgggttgaatgaggcaatgatcaatcaaatcgaagaagcgctagaaaaaagagaattgatcaaggtatctttattgcaaaataccgacgaagtggcggaggacgctgctacagcaatcagtgaagcgattcaatgcgaggttgttcaaatcattggacgcgtgattgtgttattcaaaccatctacaaaagaaaaatataaaaaaatctctgtaaacgtacgttcattataggagtgatttgacatgcaaggaaattcgtttggcaaagttcagaccttatatacaacagaagcggcttatcaagcgcctaaaaaacaagtgggcatactgggggggaatttcaaccccgttcactatacccacttggtcatgggtgaagaagttgggcaagctttgggcttggataaagtctattttatgcctgagtatcttccgccgcatgtcgatgaaaaaaagacgatcccggctgctcaccgactggcaatgttacagttagcgattgcggataatccccgatttgcgattgaagacattgaattgaaacgtaaagggaaaagctatacttttgatacaatgaaggaactgactgaaaagaaccctgatacaagttattactttattattggcggcgacatggtacaatacttgccgaagtggcatcggattgatgaattgatggagttggtcaccttcgtcggggttcgtcgtcctagttatcccgttgaaacaccctatccgatcatttggatcgatgtgcctttgatggatatcagctccacaataattcgtaagaaagtgcaacaaggatgctcgattcgctacttattgccggaaaatgtgttaaactatattcaagaaaaggggctgtatctggatgaatagccaacagtatacgcctgctgaacgcgaattattgatgcaggaagtacaaatgcatatgagccaaaaacgatttcagcatgtactaggtgtggaaaaaacggctgtcgcattggctgaaaaattcggtgcttcaccggaaaaagccagtatcgctgcgctgactcatgattatgccaaagagcgtccagatgaagaattccagcttgtcattcggcgagatggttttgatctggaattgctcaattggagcaatgctatttggcatggtattgtgggagccgattttgttcagcgagagttaggcatcgatgacgaagagatcctacaagccattcgtatccatacgactggtgctgcagaaatgagtttgttggataagatcatttacgttgccgattatatcgaacctggtcggtcatttcctggtgtgaaagaagcccgtgaattagctatgattgatcttgacgctgcagtagcttacgaaacgaaacatacattgctttatttgattgaaaaggaagcaccaatttatcccaagacgattgaaacatacaatcattgggtcgcaaaccattaggagggaattaccatagatagccagagaattttagaaattgctgttaaagcagcagattcaaaacatgccgaagatattatggcattagacgttcgtgaaatttcattattagccgattactttgtgatttgttcagggaacagtgacagacaaatcaatgccatcattgatgaagttcttgacaaagaagaagaaaaccaagtggaggttcgccgtgttgaaggaaaagatggtggtaaatgggtcttgattgatcttggtgatgtcatcgttcacgttttcaacgcttcagaacgtgcgttttataatttagaaaaattatggtcagatgcaccgcttgttgatctgaatgaatgggtcgtggcttaataatggcctacgaaacatttgcttttgtctatgacgaagtaatggattccagtctctatcaaaagtggctggatttttcttgctgtcatttaggtgaaaaaaaacaaattatggaactagcctgcggaacaggtgcattagcagtagaattcgcaaaagcgggttttgatgtaaccggcttagacctttcagaagaaatgttgatgatcgccagtcagcgggcggaacaagaggatacgcccatccaattggtagaaggggacatgctggatctgacagatgtgggaacctacgaagcgatcacttgttactctgactcaatctgttatatggaagatgaacaaagtgtccaacaagttttcgatggggtttataacagcttgcgtgacgacggggtatttatgttcgatgtacactcaacgtaccagatcgatgaagtattccctgattacagctaccactatcaaacagatgagtttgcctttctctgggaaagttaccaaggagaagttcctcacagcattgaacattttttgactttttttgtgcaaaatgaggatggaactttccaacgaatggatgaactacaccgagaacgcacctattcgcttgaaagttatcagcggatgttagaaaatgctggcttctctgaaatcgaaatgtatgcagactttattgatagtccgccaaatgaaaagagccgtcgttggttctttgtctgccgcaagctttgattgtttgcggttttttttagattaaaaagaacttaaatttttttgctgatgggagaaaggagtggagaaatgcaagcatgcggtattgttgtagagtataatccttttcataatggccatgaatttcatgtccagcaagctagaaaagcatctggagcggatgttgttgtggcggtgatgagtggcaactttttgcagcgaggagaaccggcaatcgttgacaaatggcagcgtgctcgagctgcactcgaaaatggcgtggatctaattgtagaattaccgccggcttggtcagttcaatcagctgatttctttgcaaaaggagcaattagaattctgcaatcattggattgctcctttttatgttttggaacggacgctcccgaaccatttgattatgaagcatttgcgcattttgagcgaaacaatcaagaagtcatcgaccagtttttccaagagaatgcttctgagaaccaaacctatacacaaaaaatgcatgcggcttttgcagcagtctatccagactttttggcagaggctcatttgcctaatcacatattgggcatgcgctatgctcgtgaaacgtgtcagtatccatcaccaatgaaactgttgccgatttcaaggaaacaagcggcctatcactcacaagaattgtctggtgggatgattgccagtgcgacggctattcgcaaagctgtgaaggcaggtcaagagattaaagggtacgttcctgaaagtgtaagaaatgatttattagaccaaacgattgattgggagtttttttggccattgttgcagtaccaacttatcgcaacccctcttgaacaattgcgaacccggtatcaagtgaccgaaggattagaatatcggatcaaagattgtttacacgccacttcttttgcggaatttatggcacttctgaaaacaaaacggtatactagaactagacttcagcggttgatgtgttatctattgtttcaagcaaccagtgaagaagtccaacaagcgcaaaagaataccgggattcgtattttggggtttacaacagcaggtcaaacttatttaaagcaagttaaaaagaagacagacctgccgctcatttctaaatttggcaaaaaggaaagcgagcgttttgggtattctttacgggtagatcaaatctatcagttggcatcaccacagattgtagaacaaaattttggtcgttcccctatttttctaaagaattgaactgaaattacttcacagaacaggaaatcacaagtataatgattaaggaattttgattataaagaaagcgaagtgaaattatgggtcgtaaatgggcaaatatcgtagcaaagaaaactgctaaggatgcaaacaatagccgagtttatgcaaaatttggaatcgaaatctacgcggcagcaaaatcaggtgatcctgatcctcatgcgaaccaaaaattgcgctttgttattgaacgtgcaaaaacatacaatgtaccaaaacacatcattgaccgagcaattgagaaagcaaaaggttcaggggatgaacaatactccgaattgcgttatgaagggttcggaccaaatggttcaatggttatcgtcgatacattgacgaataatgttaaccgtacagcagcagacgtacgagcagcttttggtaaaaatggcggaaacatgggtgtttctggcgcggttgcttacatgtttgataatacggcattatttggtttttctggtacggatgcagatgacatcttagaatacttgatggaaaaagacatcgacgtgcgcgatgttcttgaagaagatggtcaaatcatcgtccatggagaacctagtgattttcatgtgattcaagaagctttaaaagaaaaaggaattactgagttttcaattgctgagatgcagatgattcctcaaaatgaagtcactttgactggagaagatcttgaaaaatttgaaaaaatgatcgatgcactagaagacttagaagatgtccaaaacgtttatcataatgtagcagacagcgaagaagaataaaagtaagacatccttgaaagtttatctgtgctttcgggggtgtttttttactttcatttttatcgttttcaaaaaacaaaggggtatttcttttggtttaatcgctttttttatgttattatttaagtaattagcagtatgagcaagaagggagcggcagagttggaagaaaaaatcgttttagagccttttgatcggattttaagcggatacgataaattagcagaagtatctgtctcagtttctgattgttctgcactgtgccgcaaatacaaaaaatacggtgtagagggataccgtttgggcggctttcgtggagccacctatttgaatcgttacttgaatgtgacggtagatcgtgcgcctttactgatttataaacggaattttttgatcccgctggtttttcgagtatcggaagcgtcccaacgcttatttttggacaattatcggatggaaggctttttcttgttgttagagtggctgctgcatcatcgtccagaaaaagcaatcattgattttcagaaaagtaatcaaattgatcctgaaagggaatatgtgatcgacagttcttatattgcttttcgtttaacagaaattctagatggttccggttttcccctcagtcactttacagatgtcgaacaatttatggaatggaaccggatctatcgattgatcgacaatggcagtattggaaaacatagtaaaatctttgatcctgacaatgaagaaaatgtttcagaacttcagatgattttgacgattgtcgcgatgaaatatccagaaacgagactctttatcggtgaattgaaggggtgatcgaaccctgtaaaaaaatgacaaaacaaataccgatcaaacaaggcttttgtcgagaagaatattgtttgattgatcatttatcgctaggcaaaaacgagagcaagggattgtccgcttgctctcgtttttttgatgtatcaatcgctttccttaaagcaattgtaatgcgtaggttgcgggatcagctttctctagcaattgattggtgttattttgcaaaacaatcaattggtgcatggcacgggtcgccatggtatagaagatcaattgatcttgctccgtcacaaaagaagtcccatacgtccataagaatacttgatcaaattccaaccctttagctaaaaaggctggaaaaatcatgattttacgtttcataaaatcttcctctgaagtaattaattgaacttgatcctgcatctcttcagagagctgggcataaagcgctcggcagtcggtagctgtcttacagatgatagctgtgcgccagtgtgactgtgatttggttaatgcttgctgcaagtagtccagaccaactgtttcgttctcggtttgaatgacttgagggagagccccttcgcgtgctgtcaattcaacttgatcggaaccagttaagaattggttggcaaaatccgtgatttctttcgttgaacgatagctggtttttaattgataccgagtcacgctgtcagcaggaaacaactcttccaacgaaccaacgatcgtttcattaccgtagaccttttgatttaaatcaccacataaagtaattccggctttaggatataattgacgtaagagagccacttgagcaggcggaaaatcctgcatctcatcaatgaaaataaaccgtgctttttcatccacatagattgggtaaagttgtttgatcaacaaaaagaatagcacggcatcttcttgggtcaattggcgttgccgcagaccttctcgcagaagtcggagatgttgttgccaatcttcatcacggatcgcttgatcgtctaacaacgtcttaggaactgcctgtaagaaatgtaaatactgcttggtttggttgataaactggtattgtttgacaccacgagttagtgagcggaattttttcttaacgatttgctgccggatttgcttacgcaatcggtgttcattttcttcggtgtactcctgataaggatctttggcaaaatgttgctgcaactgctcttcggttgcttctttgacccaatcttttttggcctcatctttttcaagaccaccgatttttttcagtaattttgtttgtaataattgactccgttgatacaaaggaagctcttgatttgtttcttgataccaacgacggatttgttctttcgtaatgtatgtctgtccttgaatttttaaatcacgaaataacggaccgatcgcagaaatcttctgtacgtatcgttgaatcaatttgacaagtttcagactgcttttgatcttttcaatccgatcgtctgctcctgataagaaagtttcttctagctgtgtttcttttgtgatttggaaattgggcagagctctttggatgaaatggtggaacgtacgtgttggcacttcactttccccaagagaaggcaagaccattgaaatataatcagaaaataaatgattgggagagaaaagcaagacttgttcttcatccagccatttgcggttgcggtaaagcaagaacgccacccgttgcaacagtgccgatgttttaccactgccggcaattccttcaatcagcatgaacttgctagtagtatcacgaatgatctgattttgtgctttttggatcgttgagacaatatttttcatttgagaagaagaggcttcgtctaaaatctccagcaaaaactcatcattgatgatttctgaagtgtccaccatagacaaaatctggccttcttgaattttgaattgacgcttcagcaacaactcaactgtaaagcgatcggtttctgtttcataaaacgtttcgcctaattctccttcgtaatataaatttgcgataggtgcccgccaatcgatgacaattgtttcttcttgctgatcccttaaagaggcgatccctagataaagtgtttctttttcttgttcttcttgaaaatcaattcgggcaaaataaggattgctagccattgtttccaatgttttgacccttttctcttgagattccgctgttcgatattttaacagcaattcttgctcgtgttgctgatattcaacaacagattcgtaaaaagcttcgctgtcaccaccacgaatcttcttttcggaaatctcttttaactgatcctccatttttgtagccaagtccgctttttgctgcgctaagaccatttgttctcttcgaatcaatgcgatcgtatcatcgacatgtagttgttctttttgacgttcgttcacaaggaatcctccttaaaaaaattgcgacataaaattatagcatataatctttgcgaatgtcgtctgaaaaatcgttctatggtaaaatttaagtatgcttttgagatcaattggatcaaagaaagggaggatagctgtgcggaatgaagctgaaatgctagcagtgattttacgagttggtcaaaaaataggtgtccaagcaatcgcaatctctgggtcccggcgagaacctaatgcaataagcgatcggtttcaagattatgatatcgtttatattgttgacaatatgcaagaactaatagcagaacctagctggctggaagaattcggacagatcatgatcatgcagactccagaaagttctgtgctttcgcaaccctctttgggaggacgttttacattcttgatgcatttttgaagatggcaatcgcatagacttgatgctttgcccggttgaattgatccatttgttgcaagctgaaccctttcttgagcgtctctatgatccaaaagaatttctgcagggaatgacagttcctgatgcctctatcttttggattaaaccaccgacagaaaaatcgtttcatgacagttgtaacgaattttggtgggtagcgacttatgtcgtcaaagggcttgtcagaaatcagcttttctatgccgccgaccatttgtaccaaatttgctggcaagagttgcttcggcaatatgactggtatctagcgcatcaagcagactatcgtctcagtaccggaaagaaccataaatatcttcaaaattatttatcagaagaagagtatgagcggttgacggcactttgtttttcatctgttgaaacttgcggcgaatccttatggaaaatcgttcaactatttgatgagattgctcgttatgtaagcagacaacatcaatttttgtaccatgaagaggaagccagtaaggtgatgaagtatgttcaaaaatggcattcgagaaaatggcgtgaagatccagccaaatgaaatggaagaatctttagattgtcagaaacgcttattcttgataagggacagtcattcgataatagagcaggttattgcagagcataattaagaagcgtatactaatgaacagaggagtgatgactatgccatttattcatgtagaattagtagaaggccgatcgcaagaacaattgaccaatatgatgaaagaaattactgaagcagtccacaaaaatactggggcacctaaagaacatattcatgtcattatcaacgaaatgaaaaaaggacagtatgcagttaatggtgattggaaataatttacttgattttttaagcagatagtggttaaatgaagccataattgattgatgaaaaagacacctgaatttgagagtcttcgataagagagggaaatcacggctgaaaatttcctggaagaaaaccaatggatgaccactttttcaaacctttgttgaaacaaaggcggtcgtaccgttatcccgtcaaagaaatacagcgttgttgtatttgaaattaggtggaaccacgaaatcttcgtcctagtatcgttatctgatactaggactttttttggttcgaatcattcattgatcaaataaatcagtagggggaaaacaaatgacactaacaattacattcccagatggggcgaaaaaagaatttgcagttggcatcacaacaaaagaaattgctgaaggaatctctaaaagtttagcgaaaaaagccttagcaggaaaggtcaatggtcagttgattgatcttgatcgagggattgaagaggatgcacaaatcgaaatcgtcacaccggatcatgaggatgctttaggcttggttcgccattcagcagctcacttaatggctcaggcgatgcgtcgcctttatccaaacattcattttggcgtgggaccagctatcgatacaggattctattatgatacagataatggagaaagccctgtaactgccgaagatttaccagcaattgaagcagaaatgatgaaaatcgttaaagaaaatctaccgatcgaacgtcgtgtattatcgaaaaaagaagctttagaactatttgctgaagatccatataaagtagaattgatcagtgaactaccagaagatgaaacgattactgcctatcaacaaggagagtttgttgatctatgtcgcgggcctcacgtgccatcaacaggacggattcaagtgttcaaacttttatctgtggcaggagcttactggcgtggaaattcaaataaccaaatgatgcaacgggtctatggaacagcgttctttgacaaaaaagagttgaaagaattcattcgtttacgagaagaagccaaagagcgggatcaccgcaagctagggaaagagttagacttattcatgctctctccagaagttggtgctggtctaccattttggttgccaaaaggtgcaaccattcgtcgtaccattgagcgctacatcgtggacaaagaagtaagcttgggttaccaacacgtttatacaccaatcatggccaatgttgacctttataagacttcaggacactgggatcattatcatgaagatatgtttccgccaatggacatgggagatggggaaatgctcgttcttcgtccaatgaattgccctcatcatatgatggtctacaaaaacgatattcactcttatcgtgaattgccgattcgaatcgctgaattagggatgatgcaccgttacgaaaaatctggcgctctttctgggttgcaacgggttcgggaaatgactctaaatgatggacatacatttgttcgtcctgatcaaatcaaagatgaattcaaacggactttggatttgatggttgaagtctataaagatttcaatgtaacagattaccgcttccgtttaagctatcgtgatccagaaaacaaagataaatactttgatgatgatgcgatgtgggaaaatgcccaaaccatgctgaaagcagcgatggatgaattgaatttggattatttcgaagcagaaggggaagcagcgttctatggtccaaaattagacgttcaagtaaaaactgctttgggcatggaagaaacgctttccacgatccaattagatttcttattaccagaacgtttcgacttaacttatgttggtgaagatggtgaaaatacacatcgtccagtcgtgatccatcgcgggatcgtttcaacaatggaacgtttcgttgcctacttaacagaagtttacaaaggcgcatttccaacttggttggcaccgatccaagcaacgatcattcctgtttcagtcgatgcacacagcgattatgcttatgagatcaaagaacgtcttcaatcacaaggtttacgtgtggaagtggacgatcgcaatgaaaaaatgggctacaaaattcgcgcatcacaaatgcaaaaaattccttatcagttagttgtcggagaccaagaagtcaaagatgcaactgtcaatattcgtcgttacggcagcaaagaaacgaacgttgaagaactaaatatctttgttgatgcaatggcagcagaagtaaaaaattatagtcgcgcataaatcaattaaaaggattgtaataaaaggtttgtaatagaagcaaaaaatgagactatccgaatgacagtggaaaaaaagtgtttgtccagctggcgttattactggtgactagttggagattaacagcatcccaatgtccttcagaggtttcgtttattaaaaagcttagattacatccttttttttcattattattgaaataaatttcctttaaaaggactttccacttttttggattggtgtataattggaagaaaagtaaaaagattcaatcttttagaaggagtaaccgatgtatcaaaattatcaatccaagaaaaagtccattttaatggtgattttactaactattattacttgcggcatctattcacttttctggctataccaaaccacgcaagatttgacagaatatagtgaagattatcgccttaccccaggcatgtctgtgttgttgacgatcattacttgcgggttgtaccaaatttattggtggtatcgaatcgcggacatttttatcactgcacaggaaaaaacgaaatttccacgtatcaatgataataaagtgttgtttgttgtcttagcgatttttggtttggacattatcaatatggccattttacaatcggatatgaatcaagtgtgggagtctgcagattctgcaagccaatcagttactcaagacactgatgattggaccgattattaatgtgtccgtttaaactgctgacgggggttccttgccctggatgtggaatgactcgcgcctatttgcatctttttgaaggtgacatacaaggcgctttttattttcatccacttttttggctcattcctttgctagtgttacttgtcattttctggaaaaagcccatggttcagcgtatcaatcaaaatcgctacttttggcttggactgatgattgctgttctgggcgtttatggctaccgcatgtggcacttttttcctgatcaagcgccgatggactttgatccgaaagctttgcttccacaagtcatcacgaagcttgtcgccttcattgcttgaatcaagaaagacagctgcctattttgagatagagggaacaaggaagtattctgaaggaagaaatcttaagaaataggatgtaaaattttcagaaaaagccacaaaatgctaggatacttgaatttgttagtaaactatgttatatttacatagtaatgatacttagagtgagtgagcggttttttcgctcactctttttaatggaatgaagttcgtttcgttgagaaataaaggaggcgatgtcgtgtgagtacagtggtggaaactgtcacaacaattgtgacccccattctggaagcgcaaaattttgaattagttgaggtagaatttgttaaggaaggaaaaagctggtttctaagggtgtttattgacaaagagggcggaatcgatattgaagaatgtgcctttgtcagtgaacaactgagtgataaattggatgcctgtgatccagatccgatcccacaagcctatttcttagaggtatcctcgcctggtgctgaacgccccctcaaaaaagaagaggactatcaccgtgcagttggagaatatatccatctttccttgtatcagccggtggaaggcgaaaagcaatttgaaggctttttgcagtcctttgatgaagaacaactagtcattaagattcgaatcaaaacaagagaaaaagaactaacgatcgaacggaaaaatattgccaaagctcgtttagcaatccaattttaaacacggaggaatggaagaatcatgagtaaagaaatgttaaatgcacttgatgcattggaagcagaaaaaggcatttcaaaagagatcgtcattgacgcattggaagccgcgttagtgtcagcgtacaaacgtcattatggtcaagcgcaaaatgtagaagttgaatttgaccagaaaaaaggcaatattcacgtttatgcagtcaaagaagtgaccgaagaagtaatggactctcaattggaagtgtctttgaaagaagccatgacgatcaatcctgcttacgagattggcgataagatccgtttcgaagtgaccccgaaagattttggtcggatagctgctcaaacagcaaaacaggtcattttgcaacgggtgcgcgaggcagaacggacaatcatctacaatgaattcagtgcctatgaaaaagatatcctgcaagggatcgttgaacgtcaggacaatcgctatatctatgtgaaccttggaaaaatcgaagcagtattatcaaaacaagatcaaatgccaaatgaattctatcaacctcacgatcggatcaaagtatttgtttctcgggtcgaaaatacttcgaaagggcctcaagtttttgtaagccgtagtcatcctgatttattacgccgtttatttgaacaagaagtaccggaagtttatgatggtacagttgaaatcgtcagcattgccagagaagcaggagaccgctctaaagtagctgtgcgctcatttgatgctaatgtcgatcctgtcggaacttgtgttggtccaaagggacaacgggttcaagcaattgtcaatgaattaaaaggtgagaacatggatattgttgagtggaatgatgatccagcggtatttattgcaaatgcattgaatccagcagaagtgactgatgttatttttgatgtggataatccgaaagcttgtacggtggtcgtacctgattatcagctatcgcttgccattggtaaacgaggacaaaatgcccgtttggctgcgaaattgactggctttaagatcgatatcaaatcggagtcagacatggaagaattttatgcaaaattagaagaaggcgcctatatcgatgaaggcgaggctgttgaaagtcaagaaagcacaatcgaggataatgagtctcacgacgaaatgatcattgcttctgatatgacggcagacgattacgaaaacatggattttgacgaaaaataagtcaaggagagatcgcgatgaaaaaacgaaaaattcctttacgaaaatctgttgtttcaggggaaatgattcccaaaaaagaaatgctgcgcatcacccgttcgaaagaaggaaccgttgcgatcgatccatccggcaagatgccgggtcgaggagcgtacatcgctatcgaaccagaggaagcgcaattagcttgggataagcggatcttggatagagtattagagacgaaattgtcagatgaattttatcaagaactcttagactatgtgacgcatcaaaaagcccgaagagagttatttgcaaatgaataaacaaaaagcattgaatatgttaggactagccatgcgtgctgggaaattgatcactggcgaagagatgacgttaaaagagattcgtcaacaacgagcagctctcgtacttgtcgctagtgacgctggtaaaaatacacaaaagaaaataaaggacaaaagttcttattatgaaattccgctcctagatacattttctgccgatgaaatcagttcagccattggcaaaccgcgaatggtggtgggcattctagatgcaggatttgcaaagaaggtgcaggaattaatattaggttaggaaggtgattgcatgggaaaaaaaagaatttatgaacttgcaaaagaatggaacaaatcgagcaaagaggttgttgaaaaagcacaatctttaggctttgatgtgaaaaatcacatgggcgcgatctcagatggagaggcgcaaaaattgcggcagtcattaggcggcaatccaaatgatcgatcatcagcaaaaccaactcccgcaaatcagaaaccagccaaccagccggaaaaacaagagcaaaagaaatttaaaacgcagagaaataatcctaacttccagaaccgacacaataatcaagggcagcggaacacgacgaattctcgtcctaatggtcaaggacaacccaaccgcccaacaagtcaaaacaacggatcaacaaatcaaggaagtaatcgaccaaataaccaaggaagtcaaaatcgagtgaataaccaagaaaatcgtaacaatcaaggacaacagaatcgtccaacgaaccaaaatagaacacaaggacaacaaaaccgtcctagcggtcaagggcaacaaaatcgcccagcacagggacaacaaaatcgtccgaaccaaggaaatcaaagtcaaaatcgcccagcacaaggacaacaaagtcgtccaaaccaaggggctagcagtcaaggaacacaaagccgtccagctggtgataaccaaaatcgcggtggaaatcaaaaccgtggtaagtcaaactacaacggacgcaacaataatttcaataacaataaccgcaacaagtttaacaaaaaagggaaaaaaggtcgtcaacagcaagagaaaaaaccacctgttccagcacgtaaattccgtgaattaccagaagtattggaatatacagaaggcatgaatgtagcggatatcgcgaaaaaaatctatcgtgaacctgctgagatcatcaagaagttgtttatgatgggagttatggtcaatcaaaaccaaccattggataaagatacgatcgaattgttagcaactgattacggtattgaaccacaagaaaaagttcaaatcgacatcgcggatatcgataaattctttgaaccagaagaacaaaacaaagaaaatcttgtttctcgtccgccggtagttaccatcatgggacacgttgaccacgggaaaacaacgttattagacacattgcgccattctcgtgtgacaagcggagaagctggtgggatcacgcagcatatcggtgcttatcaaatcgatatcgatggcaaaccaattactttcttggatactcctggacacgcggccttcacaagtatgcgggcacggggagcaagtatcactgatattacgattttagttgtagcagcagatgacggtgtaatgccacaaactgtcgaagcaatcaaccatgctaaagcagcaaaagtaccaatcatcgttgcggttaacaaaatcgataaaccaggtgcgaacccgcaacatgtcatgcaagaattaagtgaatatgaattgattccagaagcctggggtggcgataccatctttgtagaaatctctgctaaatttggtcaaaatattgaagaattgctggaaatgattttacttgttgctgaagtagaagatttgaaagcagatccatcacaacgggcgatcggtacagtgatcgaagctcgtctggataaaggaaaaggtccggttgctaccttattggtacagcaaggaacgttacatgtaggtgatcctatcgtcgtcgggaacacattcggtcgagttcgtgtgatgaccaacgatttaggccgtcgggacaaaacagcgggaccagctacaccagttgaaattaccggattgaatgatgtgccgcaagcgggtgatcgattcgttacatttgaagacgaaaagacagctcgtgcagcaggggaagaacgcgcgaaacgcgccgtgatggaacaacgcgcttccagcagccgggtaacgcttgacaatctgtttgaaagcctaaaagaaggcgaattaaaagaagtcaatgtaatcattaaagcggatgttcaaggttctgctgaagcgttgggtgcttcattgaagaaaatcgatgtagaaggcgttcgggtcaatattgtccattcagcagttggagcagtcaatgaaagtgacgtgacacttgcagcagcaagtaacgcgatcattattggtttcaatgtgcggccaactccgcaagctaaacaacaagccgaagccgaagaagtcgatattcgtttacaccgaatcatttacaaagctatcgaagaaatcgaaacagcgatgaaagggatgcttgatcctgaatttgaggaaaaaatcactggtcaaatgatcgttcgtgaaacctacaaagtttctaaagttggtacgatcgccggttgttatgtaacggaaggcagcattcgccgtgacagcggtgtgcgggtaatccgtgacggcatcgtgatctatgaaggaaaattagctagtttgaaacgtttcaaagatgacgtgaaagaagtaaaactaggctttgaatgtggtgccatgatcgagaaattcaatgatgtcaaagtagatgatgtgattgaaggctacgtaatggaagaagtaccaatgaattaagacactagttatcagggaggttttttgaatggctaattatcgtgaccgtagagttgcccaagaaatcttaaaagaagtgaatcaaatacttcgtaagaaagtccgtgatcctcgtgttcaagatgttaccatcacagatgttcgcgtgacaggggacttgcagcaagcaacgattttctacagcactttgagtgatcttgcatctgaaaagcaaaaagcacaagccggattagagaaagcaacagggttagtccgtcgtgaattgggacaggcactgtcattatataaagttccggagttgcaatttgaactagatgaatctgttcaatatggaaataagatcgatgaaatgattcgcgatttgcataaaggcgaataaagaatcacataaaaaaaggccgcgtatatgtagtgaccccaaaaagttagacttttatggagtggagaaatccactccttttttgtatgataagattaactgttagacagctgtttttacagcttctcgaaactgaaccggacttcgccaatttaatttctttttgatgcgtttatggttgtaataatagatatattggtcaatttttgttttcaattcatctaaactccgatagacttctccgtgaaaaatctcttgctttaataaaccaaagaagttttcacatagtttatttttnnnnagccaatcgcagtgattcatacgaaggttattactctcccttcggtcgcctagtactgctcatcatctgctctgtcttgcttcgcaagccaatcgcagtgattcatacgaaggttactactctcccttcggtcgtctagtactgctcatcatctgctctgtcttgcttcgcaagccaatcgcagtgattcatacgaaggttactactctcccttcggtcgtctagtactgctcatcatctgctctgtcttgcttcgcaagccaatcgcagtgattcgcagcaaaacgcgttgtccgttgggacaacgcgtggggttattgcacgatttcaactgttttgattgaatttcctggaacttgaggtgggattgacatagtcattactggcaagcctgacaatgtgacttggaccgttgttcctttggtcaactcagaaacttgaccttcaaatgattcttgcggtgcgtgtaggatcacgccgtctgtttgaaagttaggaacaatcgtttcttgatcgtcgactgcttcgatatcatttagaaaaatctgtatcgtttcgttgtcgccagctgttgcattttcttgaagaactcctgtaaaaatagtcgttgcctcgctttcgacagtgctatttgttgtgctttcatcgtttttagttgtttcactcatcgaatcattatctgacggcgaaccgcaggaagctaataataaggttgtcaaagccaaacctaaaatcgtcaatttcttcataagaagttctcctctcttctatatttccgaattccggcgatttttgccagtcatttggatctcttttgtcaagtaacgaattcgttccatgatccgcttggctttcaatggctctgattctccacgttgagtaacggatagatgcttctctaactcttgcatggaaaagttggaggaaaagaacgttggcagttgttcttgcatccgatattgcagaatgacaccaaagacttcatcacggatccagctgctcatggcatctgcaccaatatcatccatcattaggatgggggcttttttaactgcattgagtttgtcgccaaccaagtctttgccgattgcttgtttcatttcgacagcaaatgtcgggaagtgaacaagggtcgtcgtataacctgcttccgcaaggtcccgggcaattgcccctagtaaataagttttgccgatcccaaaactacccaccagatataatcctttgtgaaaagcccttggatcgttttttaggttttcaataaactcgactgcagccatcaaagcttcgccccggccgggagtactttcatactgagcaaaattggcctcttgaatatctttcggcatatccattgctttgatgcgactacggatctcttcttgtcgttgatgcgctaaaagctcttgcgtgggcacataagtgacatcgataaaatgaaagttcaacgctagtcgtggctcatatccaggtgcaatcatcgtagggtcattcaaacgaaactttcgtttttcttgaacaaattcatagagtttcgcataacttttttggatatctgcatctgtcagttcctcccgatgttctgaaatgaattctttgacatccggatctttcaatacgtcccccatcatttctgagaaacgatcgcgatagtttcgtttgtctaaaatttttgatagattcttcccaacatcttccattaattgtcacctgctttcttttgcaagtaggcttgcagttttttgtcgatctctgcctgacgttctggggataatgtcgtttcttcaactggtttttcggcccagcttggcagtttttcttcacgaatgatctttttagacgggctttgcggccgtgtgcgtttttcttttgcttctttaactaagtcccgtacatgcttgatcgcttcttccgcggtttttacttgcaattcagaccattgtgccgcaatgttattgacataacttgctggcaaagccgcattgttctgtaccactaacacataatgaataagaacattgatcacactattggataatggcgagcgttccactaagctttttagcagccattgttcggagtctgtgacaaagctctttttttcagctttgattgctttcaagaatgccatcggcgcattattctcactttcgcggatcaatgctagatcgttatcactatacccattttgttttaatgtattaaatcgtcggatctcttcatctgaagtgggatccactttattttcagttttggtaaaacgcgtccgtgctttttgtaaaatcaattgttctaatgccttctgatcgattttcccagtagttaaagaaaccgaatctgtcatcagatccaacagctccatcacatcatagccgtataatgaatgatataggagtagtttttgccgaaaatctttatcgaaattgtctgcacggatgtagcgacgttgagcttcataaagaagaaaatcccaatctagttgttgttcatctaacaccagtctgctttgagtgtcttggaatttgccattgacttcctgtaattcctcttcattggctgcaaattgttgtgtatccaagcgataagcatccataaaagaagccgtaacttcttgatagccttctgcttgccattttgctggttggaacaacgaaacaagttgtcgaaactttcgctctccaacatggttaagcaataagaaactatagagttcatcttgaaagaaatcgctcgcatgaactggctcttgcaggtgatacaaaaatgtgattcccaactcgtcatcttctttttcaaacgttttgagtaagccgattccttctaacttatttcgtgcttgaataaaacgctgtaaccctacattcatcgcattcaaaatatctagatgaataaactcactttcttgcggatcctgctgatccgcagtcagtgtcagatagagtgctaaggcatcactttcgatgattggctgataaagatgaatcagcgcatccttcccttcagttgttagtggacgacttttgaagacacgatacaattgatttggtaatatgttgcccaccattcagggacctcctattcctcttgattgtctgctgtttcttgcggatcacttggttcttttgccttttcaacgatatcctgcaattcttttaagaagactgacatatctttgaattggcggtagacactagcaaaccgaatgtaagcaatctcatctaagtcgactagatcttccatgacatattcgccaatcatcgttgtcgaaacttcattttcacctagtgctcgcacacgattctccacatgatcaacaattttttccatttgttccattgtaacgggtcttttttcagcagagcgtatcaaccctcttaatatcttttcacgattaaattcttcacgagcgccatttttcttaataactaataatggtgcttcttcaattcgttcaaatgtggtaaatcgataaccacagttttcacattcgcggcggcggcgaatcacgcgaccatcgtcggcttggcggctatcaatcactcgagaattgttatgatgacattttggacattgcatagttccaccccgttctctcttccgtgtctcgaatgatagcgagacagcgatgatttatatgcttaattataacatgaaattcttctatctaataggtaaagtctttcaagcgaaagaaatattacaaatttaaataatgtgacggttgtttttttagccacaaaagaaaaacgacagaatcaattctgtcgttctcctccttatctcatttgtaacagtgacacaaactcatccagagtttcccgttgttccatttgttggttgcattgctcactgtcgcgacaaatgtaatttcctcgtttggtgtatgttccatcgccaccactttttgtcaacgataaaaacatggagacagtagactcatgttgacataaaggacagattcctttttttacttctgtagataaatgaccatagattccttggtagcctttttgagtatttacgatcataaatttactttgactgccgatgtcatcccaagccaaatacgtataatcacgaaggtctgtttgggaaaaatcaggtacttttaatttttttactttacgaaacagtttctctgtttgtttgactgaaggcacttgaaaaggtcggacattcttttttagtgcttcaagaatggtcaagctctttgacatcgtcaaagatgaatcaaaaaattgacgaatcagagactgtgcttctttgtcctcctcagaaaaaaatggttgaatggcttcttcagttaacatttcaactgtgcgaatcgtatggcgatcattaacagactgataagtccgaactaattgttggacttgatgtttgatgaaatgaaattgatagggttcaatggtaatcataatagatatcgatcctctctttaatgaaaaagcaaaagatattactgataaattcctctgatcacagtcaaggacaatgcagaattcagcatttgttgaccacctcctggacttcccttttttgtggaaagtcattggctattatagtttttccttcaggggttgtcaatcattgtccgcagacagcattcttttcttgtcaaagtggaattattgataccttttaaaacaggattttcttcttttttatctatttatattgattgacgaatatggtttatcataaaaaaaactccagatcctgtctagagtttttcttcgattcctgtataatgtttcaaatgatcagcatcccgtcgttcggttgaagagatctttgcagcatctgtgtcttcattttcgtttagcaatcggtcccgaccaagtgtttctaatgttttatcacctggttgagcatctaattcatcatgccgatcctcaatttcgtctacctgttgttgacggtgatcttttttggcttttgcttcatttgcctgttcttttccttcttgttccattttttcattattgatccattcaccaattttttcttttgcagaaccaacaattacatctttttcgtctttcaatgatcccatgatgattcctccttttttattagcatagcaagaatttcttcgattgacaaaagatacgtatgcgcttcatttaaagatatggtatactgaatcaaattttcagaatattctttgacaaggagcagtttatggacatcttaaattttgaagacatccagttggttcgcaagcaaactgttttgttgcaagacatcaactggcaaattgctaaaaatcagcattgggcacttttaggattaaatggtgctggcaaaacacttttattacaactgatcattgggatgatctggccgacttctggcaaacggcaagtcctaggtcaagtctacggaaaaacatctgtgccagaccttcagcgcagaattggttggataagtgcgaccttgcaagagaagattcctgctcaggagctctcagaaatggtcgttctatcgggaaaatatgctagtatcggtatatatgaagactaccaaatgaaagacttgaaccaagctattgccattctttgttcaactggcggcagtcaactgattggccagccatttcatcagttatctcaaggggaacgtcaattagtcttaatcagccgcgctttgatggcaaatcccgaattgttgattttagatgaaccttgtaatggattggatctttttgctcgagaagaattgctaagtcgaattggcgagatggtgcacaaggaatcacctacgttgatttatgtgacccaccatacagaagagattttaccgatttttgaccatatcatgatgctgaaaaatggtaaaatccacgcttctggcaagcgccagcaaatttttaacgaaaaaacgttatctgctttttatgggaaacctgtttttttccatgaagtcacttccgatcgcctggcagttttaccaaaaagcaactcactaaacaaaaaatgaaacaaaaaaagagacagctacaaccaaagcctctttccagatatcctttctagcttcagtttccagcaaacgacaaaataatgcgtcaactgttagcttttcagaaataaagggggctcctttgtgccggtgtctctgtcttaattctttcttttagcaagccattcttgtacttgcgtcttaacttcttcaatggttccttgattgtcaaagaggatatctgcccgtttgcgcttctcttctattggcatctgactattgatacgttgttgggcttcgatgctggttaaatggtctcgcttcatcagtcgctgcaactggatcgattccggaagatagacgaccgctacttgatctagcagggattcataaccagtttcgtataacaaaggaatatctacgatcacaagatcagcttttgctttcatgacttcaatctgtcgtaggatttctttacggataaagggtcctaatgagcggttcagcaattcccgtttattgtcatccgcaaaaatgatttttcctaattttttccgagctagtgtcccatcgggattgatgacctctggcccaaaaacagttttgattttttcaagccctggcatccctggctccaccacttcgcgagcaacgatatcagcatcgatgattgggataccagcttcttcaaagcacttgacaacggtactcttgccagtagcaatcccgcccgttacacctacaaccaagctcatctttctgtccccgcgtgtaattgctgacagaatggacaatagtgggtccctcgttgtgcaacttttgtttttacgatcggggtaccacagcggacacaaggattgccggtttgaccataaacgtgtagagagacttggaaatgccccgcttcgcctaacgcattcaaataggtccgaatcgttgtgcctcctgcctccactgctcgggctaagacatcaatgatcgcccgatgcaacaagttaatttcggcttcattcagtgtcgctgccgattgctcgggatgaatctttgcttcccataaagcctcatccacatagatattgcctaaacctgtcacaagcttttgatctaaaagcagcggcttgatggctttttttgatttctttaggtcacgagtaaagtctgtcaacagaaacagttccggcaatggttccggccccaactgcatgattcctttatacgtactgctctggtctttttcaactaaagtcatacgtccaaattttcgcacgtcccgataatgcaattcactgccatcagtgaattgaaaaatcacatgggtgtgtttgtccggcaccccttctttttcaaaaaattcatacttgccttccatgcgtaaatgggaaatcagatcataatcggtcaatttgaaaatcaagaatttgcctcgacgatcaaaagcttgaaattgttgtccttttagcatcgctgcaaaaatcggtacttctggagattcaatgatccggggccaacgaatctccatttctttgatcgttttatttaaaatcagtttctctagtcctctgcgaactgtttccacttctggtaattccggcacaacatttcacctcatttattttgcttcataccacgttttgccccagttactatctgtcaacaatggcacatgcagtgagacagcattttccatgacttctttgacaagagcatctaagcgttctaattcatcttctggtacttcgaagacaagttcatcgtggacttgtaaaagcatcgttgcttgtaatttttcttcctttagacgacgatccaaatcgatcatggcaattttcaaaatatctgcagcactgccttggatcggtgtattgattgctgtacgttccgcgaatgtccgcaaattaaaattgcgggaattgatatctggtaaatagcggcgacgatgatacaatgtttccacatagcctttgtctttcgcttcacggacaacttcttccatataagttttgacccctggatatttttcaaagtaggtatcaatatattgctgcgccgctttgcgagtgattccaagattttgggagagaccataatcagagataccataaacgatcccaaagttgaccgcttttgcttgacgtcgcatgtttggtgtaacttcttctggagtggagatcccaaagactcgcatagcggtacttgaatgaatatcttgtccttctacaaaggccgcttttaaatgctcatcattcgagatatgggctaaaacccgcagctcgatctgagaataatccgaagaataaatgacccaatctttggctcttggaacaaaggcttctcgaattttccgcccttcttctaatcggattgggatattctgcagatttggatcaacggaactcaaacgtccagtttgtgttaaagtctgcacgtaacgggtatggactttgccatctccttgaatcactttaagcagtccttccacataggtggattggattttggcaatttgacgatagatcaaaatgtcttcgacgatcggtgcctgttccttcaactgttccaaaacatccactgccgttgaatagccagtcttagttttcttgatcactggcagccccattttttcaaataaaatcacgcctaattgttttggcgaatttaaattgaactcttcgccagcttcttgataaatcttttgttcgatttcatgcaaacgttctgcaaattcgcccttcatctgatgcaaacgagaagcgtccacgcgaatcccagtgatttccatctctgctaaaatttttgataatggcaattccatatcagtaaagagtgcagtctgatttttctctgctagctctttcgccaaacggacagaaaggtagttgatcgccgcaacttttcgagctaaatgagcgaaaaagacttcttcatctgccggtagtcctcgtttcacacctttgccatagatagcttcgtccgattgaatcgcatcaaatccataatgcttagcaacaccagcaatatcattatttgaatcattggtatctagcaagtaagcagctaataatgtatcaaaaacaatcccttgtggtgcagccgcataacgattcagcgccacatacgttcgttttgcatcatagactttcttctgtgaagaggcattttttagccaagcaataaaatactcattttcaaagagatcatcttgattggtcacataaattttttgctgattcccccaagcgacaccaacgatatcttctaaatgatagttatcgcccagcatctcgatataaagagccatatcctcagtaaacatttccggagtgacctctgttacaacgtcaaaaagaatatcttccatttcttccggttcagtcaccacatttaatttttccaagaaagaattgaagttcatttcttgatagaatggaatcaatttatccagatcttttccttcgtacttcaatgaatcaatggccacatccactggcgcatccacatcgatcgttgccaatttttttgacaaaaaggctgtctctttatcattgagcaagttttctttcatcttgcttggcttcatctcatcgatatgctcgtagattccttcaactgaaccatattctttcaaaagtttgatggccgtcttttcaccgatttttgtgacaccgggaatattgtcagaggcatctccagctaatcctttcatatcaatgatctgtaatggcgctaaaccatcatatttttctgcaacgtgatctggcgtataactttcgatctcgctgacaccctttactgtgatatcaaccttcacatggtcggtagccaattgggtcaaatcgcgatctccagataataccacaacatcaaattgctctttgtcaactttttgtgccaatgtgccgataatatcatccgcttcataattgtccagttcataatactgaacacctaaagcggtgatcaattcgcgaatatagggcatttgttccttgaattctccaggcgtttttgaacggccgcctttatattcctcatacatcgcagtccgaaaagttgttttgcccgcgtcgaaagccaccaggacatgagttggctgttcttttgccattacattttcaaacatggtgtgaaaagcgtaaatcgcattggtatgcaaaccattgttgtttttaaaacgttccaatgaattgtgcagtgcaaaaaaagcccgaaatgcgacactatttccgtcaactagcaataatttattttttgtcatttgaataactcctcacctcaaaagttctctcttattctatcaaagaaatccatgaaaagcgatggattgcctttgttcgattaagccaattgcaaaaaaaaatgcgagtttcctcgcatttcctcattagttgtttttaccaaagattcgcaaaatcgctaagaacaagttgataaagtcaagatacaactgtaatgccatgaagacagccattccagtatttgcttggccattcgttgcttggtatagattacggatctgttggttgtcataggcagtgattcccataaagacaaatactgtcacgatcgacaagaaaaagtcaactggaccactatgcaaaataaacacattcagcaatgtcgaaatgatgatcccgatcaatatgccgtagccgattcgtcccacaacacttaaatcacgttttgtcatgataccaaatgctgacattacgccgaaagtgatcgctgcggaaacaaatgcacctgcgatcgatccgaagtcataatacattaatgtaactgacagcgtcaccccatttaaaagggagtaaaccagatatcctgctatggtcagcgaaggattcttttgcgcttttgcgcctaataccaagaccaaaataatttgaaggatccataaccctgtaaagcctagtggaaaattacggataaaattcattgtttgttctgcaaatacttgtccgaaaaagtaggcagacactgcgctaattcctagtcctacagcaaaaaatagatagactttggaataaaaacgattgagcccttgggcattaactacttcattgttcattttcttcaccttcctctacgatttttggaggttggaccatcactactgcatccaacacacgatcttcttgcgtattgacagcttcaacagagatcgtcactacgtctttcatcttatcgactttgatcacttcgaaatcgaaggtcaacgtctcataatgaaaaacaggttcaataaagttcaccgaaaaattcaccacatgagaacctggtcctggcaaatgtttagaaatcgcacttgtaataatccccatcaacattacagaaggcacgattggccgttggtattctgttttttgggtatagtcatgctgaatataaagcggattggcatcatttgtcaaaccgagatacaacaaaagctgactgtcttcgatcgattctgttaaagataacgaatcgccttcctcgatttcatcaattttcttacctaattttcgcggtttaccaatgttcaaatttatttcctccaaaataaataattttactctgatttcattttatcagatgcagataaaagtgcaagttcgtggtgcgatgtcccaaaaaagcaaaaacggggtgctgacttttgtcaaatcgatgcgagcaatagcaacgaaggctaaatagtaagtctcactggttgattttgtatcatagttctgttgacagccagtgcaaatgagataccatttgtttcgttgatctgctcgggtgatttgatttggtcatcgctccgtattttttataacacgtttcgagtcgtattactcaacaacttttcataggctgattcaaacttttgtacgtccccggcacccatgaaaatgatcacagcatcttgatgatccaataatggtgacacattctcttctttgatcacttgtccacccttttgaatcttgttcccaagatcttcaattttcacatcgccgcgagattcccgagccgagccaaagatatcgcatagataaacgctatcggctagatccaatgcctctgcgaattcgtccatcaatgcaatcgttcgggtaaaggtatggggttggaaaacagcgataatttctttttcagggtatttttggcgtgcgccgtcaattgttgctctgatttctgccggatgatgagcataatcatcaacgattgtcatatcagcgactttcttctcactgaaacgacgtttaacaccaggaaatgacaacatttcttccgcaacttctgtcatatccagcccttctttataggctactgcaatgacccctaaagcgttgttgatattatgttggccaaatgccggtaacacgaaatgaccgatgttttcgttatggatatagacatcgaactcagaacctgtcgttgtacgctgaatgttttttgcttgtacatcatcatcatcattcacaccataataatagatcggtacatctgcttctaattttcttaaataggcatcgtcaccaaacgcaaagattccttttttgacttgcttggccatcgattgaaaagctgagaaaacatcgtcgatcgattgataataatcagggtgatcaaaatcgatattcgtcatgatcgcataatctggagaatacgctaaaaagtgacgacgatattcacaggcttcaaatgagaagaactctgcgttagggtctccatgacctgttccatcgccaatcagaaaactagttggacgaacaccgctcaacacatgggacaatagacctgtcgtactggttttaccatgagaaccagtgactgcaatacttgtgtaaggttgaatgaatttaccaataaaatcatggtaacgcgtaatttctaaccctaattccttcgcacgaaggatttcttcgtgggtatccggaaaggcatttccttggataatcaccatttctggctgaatattctctttatcgaaaggcagtaatgtgattccggctttttccagatcacgctgtgtaaagaagtactcttccacatctgaaccttgtacatgatagcccttttcatgcagaaccaaagccaatgaactcatgccggaacctttgattccaacaaaatgatatactttgtcttgattttccattttttaaaatcctcttttctcaagttcacattacaataaacgcatgtttattaacatttagatttgttgcacgtcctacattatcatacaaaatgaaaaaaatagcaacgagttttgtttttgggcttgactttttgctcaaatcgctatttctttcaagcgtccgcgacactttccacagccataacgtttagtgttcagccttctcgttcgcttgatcacagctccacattgttgacactggtactgatacttcgcatttttcatcatacttggagcataacgaagtccaccagtagctgccaaaagagctttgaattctggatctcggtgtcggtagcctttgccagctaaatgcagatgatagtgacacaactcatgcttgatgatttgaatgaatgtatctacaccaaattcagctaataaatgcggattgaaatctaaatgatgatcgcttaagtgataacgtccaccggtggtctttagccgcccattgaaatacgcctcatgttgaaatggtttgccaaacgattctagagaaactttttcaacgagctgctgcaattctttggtggtcattttccgtgtgttggatcaaccattgtcaagctgattcggcctttcgtggtatcgacttgttcaatccagacagtaacgatatctccgacagcgacaacgtctttcggatgcttgacaaaatttcggcttaattttgataaatgaaccaaaccatcttgtttgacaccaatatcaacaaacgcaccaaagtcaatcacattccggacagttcccatcaattccattcctggtttaaggtcttccatgctcaggacatctttacgcaataatggtgccggcatctcatctcgcatatctcttccaggttgcatcagtgatttcaagatatctgtgatcgtttcttttccgatcgctagttgtttagaaagatcagcaacatttaactgtgcgagtcgttctttggcttctgctgattgggctcctagttgagttagtttaactccagcaacttctaaaatttctttggctgcagtataactttccggatggattctagtgttgtctaaaatattcttcccaccagggatccgcaaaaatccaatcgcttgttcataagctttaggtcctaaacgaggcaccttttttaattggcttctttgcgtgaagctaccgttttcttctctgtaagcaacaatattttgtgcagtcgttttattcaatcctgagacatgctgcagcagttgaggactagcagtattgacatcgacccctacttggttgacggcagtttcgaccacaaaatcaagttggtcactcaatcgtttttgtgaaacatcgtactggtattgaccaacccctacagattgaggatcgattttgaccagttcagctaaaggatcttggagtcggcgcccgatactaatggcgctgcgttcttccacttgcagatccggaaattcttgacgggcgattgggctggcggaatacacggatgcacccgcttcattcacaatcacataaaatacttcatgatcgatttgtttcaattgttcggcaacgaattgttctgattcacgacttgccgtcccattcccaatagcgatcatttggacaccgtatcgattgatcaaacgttgcagtgctggaccagctgcttggcgtttattcatcggtgccggtttatgagggtaaataacttcgatggctaatactttcccagtttcatcaatcacagctaatttacaacctgttcggtaagccgggtcaaaccctaagacgatttttccttttaaaggtggctgcagcaaaagatttcgcaagttttcaccgaagatggcaattgcttgttcatctgctttctctgttaattcattgcggatttcccgctcaatcgatggtgcaatgaatcgtttataagcatcaagataagcctcacgaacaaatggagttgctggtgaattggcgtgcttaatgagttgccgttcaaaataatcagtgatttttgactcatcgacgactaaggcaacctttaaaacatcttctttttcaccgcgattcgttgccaaaatacgatgagaaaccattttattgatggggtgctgaaaatcgtaatacatttcataaacacctttctcatccttttcagtatcgcgaagtgtactcgtgtaacttcccttatttgcaaaataacttctgatccaagaacgatagatcggctcatctccaatggtttcagcaatgatctcgtgggcaccttgtaacgcagattcagggtcagggatggcttcattggtaaattctgccgcttttgcatagacatctcctgttgttggaaatgccgctatccagtcagctaacggctgcaagccattttcttttgcaatagttgctttcgtacgccgtttttgtttgtaaggacgataaagatcttcgacctgctgcatttttgttgcttgctgaatcgattgcgccaattcactagtcaattttccttgttcgtcgatcaaccgagcaacttcttgcttgcgtttttccaaattctccagatattgatagcgctcttcaatttcacgaatttgtacctcatctaaaccgctagtcatttctttgcggtagcgagcgataaacggaacggtgtttccttcatggagcagttccagtactttcgtgatttgtcgttgattgtaagatgtggtttcctgcattagtaagtgcaacacatcatgatttaattctgccatattcgttcacctttcaatttaactgctctaagtttaacataaaaagtttaacataaaaaagacacctcagaaaagagacgtaagtaacaggctaaaaacagaacatacagaacatgaggtgcgaaattaaagctcaaggtataaaccagcaaaaaacacttccgctgaatcatcagcaggaagtgtcatctacattcaaaatctttcttcaacgtcctcgaaagccttagttattaccaagcatggatgtttcctttttactatgcggatccatcttaactaatctgtttggaaatagtttgtataccctatctttttccaaggacctttagacccaatagtcataatgacacatagattcctctatgattagaaaagttttttaaaagtctggatgccaagggccggttaaattttgatattcaatatcttgtacaatgccgtcttcattaaaaatcacgccgtgaacggaaccaccaaaaacagcccctccatcaatgccaatcttattatcatgaaaccataaatccgttgtttccatgtcaccatgaagcatgggtgtgatggtatgtccaaagacgattgtttttcccgtatgattttctccagtatgaaatggctctcggatccagataaaatcgtggtcagaagtatcctgccaatgcttcttggtcaaatcaacaccagcatgaacaaaaagatatttttgccattcataagaaagcggccttgccatcaaaaacgccactaagtcacggtagcgactccggatcattaatgcaatctcagttggcgagtactcttctgttgctcccggatgtaaaagactttccatcgtctccttgcctccattgcggacataagcggaataccagtcttctggtgcgttcaaaaattgcagaaaatattcttcatggttcccgcgcaaataaaccgctcctgtctcttccaccaattgtttacccaacaagagacactctttacttcgtggccctcgatcattcaagtccccaatcagaacaagctgatgcagtgatggatcgtaatccaataaaagttttttaaaaagatcatacatcccgtggatatcactaatgacgtaaatgagttttttcatttgggttcatccccttctttaaattattataaaaaagccagcgaaactttacaactgttagccctttccttataataaaaccaactaaaggagcgagaagatgaattggctgcatcaacaatggatccattttaaaaaagacatgcgagaagcttttgatacaggggctatcgctgcacatggtaagaaatagtttgaattttgattgttaattgattgaatcaaaaaaagagaattctccagttaagtactgggaattctctttttttattttccagaaacagcaaagtaattaccatctggatctgcaaaattaaagaccattcgttcttccatctggatcaggtcgccaacttctacatttgtatctagtaatttcttgtaaagcgttgtgatatcttccgaaaaaaacatgatcgatggtgagttcaatgctacttcaggagaatgggcttcaataaagcctttatcataaagcacaaaacgagcatctgattcgctgcttggtgctatttcaacgatagaagtcccatctgccgtttgctcttcaatgatttcaaatcccaatgattgccaaaacgcaacggatttgggcacgtcctctacatataatatgatctgcatttgattcgcaaacatatctctcactcctctgttgttgatgattctgatgtttctgaggcttcatttgacgtattgaaattcaattgcagacctggtttgtcggtaatgatttctgttacttcataggttaagcgtttgataatatcaaacagcggctccactaagcggtctgtctccgctttgcttaagtcttcacctgaacggacttgccggttcaagatgtgattgacctgccctacccgaccggacagcacatattcaggaaaaacgagttgaaattccaagcgggcgccaataatactattttgtttcatatactcttcatcttgtaccttcaacggggcaaagccaacattcaatttggtttccatttctttgtctttaggcttcatatcgaaatgataagcttcgacgattggttgttgtcgtttgatttccacagtcttcacactccttgattaaaagtatagcataccgatgacatccagcctaccttcattaaaaaaatccagacaaaaagaagcaagatctcttccatgctagaaaacttgttccgtcgttacaattggatcgttaggatacaatcttgacttgataaattgtttttctatctgatggttcttgcttcctgatggattcttgcttctatttcgttaagtaaaattttttatttaagcgttttgagataatctagtgcgtcttgcacatttgagactggtacgatcttcatgtcagtccctagtttcttcgcagctgctaaagcttcttgataatttgttttgatcgaaggatcaacttctttttcttccttcgtgatttcatcctctggtgcaaaaaagatttctacaccactttcacttgcgcttgctacttttttatcgataccaccaatgcggccaacggttccgtcactggaaatcgttccagtaccggcaatattatgccctttacgcaggttttgctgcgtcaattgttcgtagatttctaatgtgaacatcaagcctgctgatggcccaccgatatttcctgcatcaataacaatatcttgatctgaacttatttccgtatggtcaactaacgaaatgccgatgccggcttttttattcgatggcaattcaatcagcgatccggttgcttctttttctacatcatcttggagatacgtcacttggatcttatcaccgactttttgactttgaacataatcaataaaatcttgactgttgtcaaatcgttttccattgacagctactactgtatcaccaacagaaatttttcctttgaagctagagttggactctacacccataacataaacacctttatagttcattgtgtagggaatatctgctagcttcagtgcttgctcaatggcactattttgagaggattccatgtagtaacgttggatccgattgtactcttcatccgttgcaccgccaaaaagttcttcttcagaaaccaagtcttgaaattgattaaatttactgccaattgccgtaaaaacggttgcctgccgaataccgacactggtcaatgaaaacgagccatcgttttgatctttttggtcattgactgtaattagttctttcaaattgatcgttgccccaggctgttcaatataataagggattggtaaaaaggcacaggcggcaactactaatgctgcaacaagtaataaggtatatttaacggttgatttaagattcatgagcatcacgcttctttacgattgcttggtaaatatttggtggtaaataggcttccacatcgccaccgaaatgcaagatttcttttagcaaacttgaactaatataactgtatttggcatttgccaataaaaagactgtttcgagcgtcggatctaagtggtgattcatttccatgatatctcgttcgtactcataatccttgacactccgaattcctcgcagtaaaaattgggcacccatttttttggcagccgtaacggtcaattccgtctcttgcgcaacaacgcgaacattcgggacatgcgctagtgcctcagtgatcaattccactttttcgccaccggtaaagaagttgactttactagtattcacaaagacaccaatgatcaattcatcaaaaagggaagctccccgttcgatcagatctacgtgaccagcagtcaatgggtcgaaactgcccggaaataatgctattctcttcatcttatccctcatttctataaatcgtgactgccgtaatcccataaacctgccgtctactttggaccaatgtgccaatcctctctggcaaatccacttcttttgctgtttcgcaaacaatgaccgcatgagttgccataagatccgcttgtaccatttgttccagctgcaaaaccagctcttgcttcgcataaggaggatccaaaaaaatatagtcgaactgctgttgagtgcccacaaattcttttagggcttgtttggcatccatttttaaaacagtaaacttttcgggctcctttgtgatgccaatattttctcgaataatcttaatcgctggataactgcgatcgacacagatggcatgtgcggcgccgcgagaaacagcttcaatagctaatccgccactgcccgcaaataaatccaataccaagccgccatctaaataaggaccaatcatattaaaaatcgattctttcactttatcggtggttggtcgggtattatccccgcttaagctcttcaattttcttcctcgataatctcctgcaacaacacgcatatgcgttcctccaaaggttccataatttcttaaaaaagtattccagtgaccgtcatctttttgagcaacaaaaatgggtgcgattggcacccaaacttttgttatacattttctgccagtcgaatcgtcgtatttttttcttccacatcaaatccatcatcactcacttgatatgctgcgtcagtgccgattttttccgcaaaattcatctcaacatctggtcgatatgaaggttccacttgccgtacgaaatgaaattgttcgattttattttttttcatttcatagtcttcttcattcaagtacatgaccacatatttcattttgcgtgacacataatggacaaatccgaatctgcgtaaattttttaattggcgtaaactatagacccatacgatcagtccccgtcgtttttggatctcaaacgtttctttcgtctcctcttgcatgacaacttcctccacatgttgattttgattgaaaaaaaggacttccagcgtccactttgacttcctctgagaaacaatcagcaatcgacactgtgatctcatcaagcaagacttgcagctggttttcactgtgtcgaaattctccgacttgaggattcaaatcaagtgcccttttggctttgcgtaatgcccgctgctgttctttatacccgggagcaaacgtgccataagcagctattttttcaaaatcggtctttttatgtacaaatgaatcaattaatcccaatacttcttggtcttggtacatcgccttcttgttgtaacaataagagcgaaacaactgactattcttgatactggaaattaattgttcaatttggtcttcaattgcatataaatggtcattataaatcatctgatgtgctatcctctgtgtgttcattctcatcttcttggattaagactaccatatttgctttagaaaaagcaattcctatcttctcaggggtttgattcgataaaacattgtaaaccgaaggatcactataccatgataaaatcgtaaatgtcggatcgtagacaggtgcttcaaagatggaagaaacggttgaaatttccttttcctttaaaatatcctgccattcttcttgggtcagagtgaaggtgctggttcgttctgctgtcaatgctttttgataggcatgaatccgttgagatgttaaatgatccgaaagattctccgtgatttcttgaaggagatctttggcttcactatgagtatctaaagccatcccaaaactttccagctctttttgatcacgcattttttggatgatcacaaaagctaacgtttctttttcaagagcagctgtttcttggttcactgtttgagactcttgaaacagcggcagctccccttctgttaattgataaggagacagcttcaataatgtcgtttgatccagataagtgactgctgctaattccgatgtcttttgatcaaaaaacaaaaccgcgaaagtgccattgtcaaacgccactaagggacgatagttcatatcttgttccataagttcaaaactcactgaacgatcattttgactcaatgtaaaattcggatagatcatcgtaagctctgtaagatctgtcattgtcatcccaatcgaaaatggggctaaggatgcgccgccttggccaatcactttgattgcctgaacactttcgccgtcggtgttgatttcgagatattgttgatcatctaggtgattgtatacgcgaacttcaaagtcatatcctgtgcgatacgtgcatatcggcgagccaaaatcttcttcaaaatcagaaagaggttcaccgatcgcttttgctaagccatctgctttgattggttcataattcaaattggtaggcgcttttacaggattatcaaaaagaggtcttgaaggagaaacccgctgaaaaaatactggctgcagatagacgacgaccagcgccaaaataaacaagcagcaaaataaaattcctctacgtttcatcttcaagacctacttcctacttctctttgatttcgatcagcaaatcacctgatgtgatggcttctccttctgcaacatagacgtgttctaccacacctgagaaacgagcttcgatcgctgtttccatcttcatcgcttcagttactagaacggtttgtcctttcgctacccgatccccttttttgactaatacttgtagaacagaacctgacatcgttgcaccaatttgttctttatttgttggctcagctttgcgttttgtttgaacggagctgatgatcgaatgatctttgactaagatctcccgacgttgtccattcaagttaaagaacaacgtgcggttgccttcaatatctggttcgccgatttcatccaagcggatgatcaagattttccctttttcaagttcaacattgatcgtttcacctaatcgcatcccattaaagaatgttggtgtatctaggaccttgacgtcggcaaactgttcatatgcttttcggtagtctaaaaagacttgcggatacatcaaatagctcaatacttcttctgttttaggctggtagccgatcttttctgctaattcggctttgactttttcaaaatctactggttcagcaaacgcaccaggacgttctgtgaatgctggccgacctttcagaatgatccgttgtaattcttttggaaaaccgccgactggttgacctagttcaccttggaagaaagtaacgactgattctggaaaacttaaggtttcacctttatcataaatgtcttgttcagataacccgttttgtaccatgaaaagagccatatcgccaaccacttttgatgatggcgtgactttgacgatatcaccgaacatcatattgacttcatgataaacttctttgatttcgtcccatttttccccaagtcccactgcttttgcttgttgttgcaggttcgaatattgaccaccaggcatctcgtgtttatacacttctgtctgaggagcattcaacccattctcgaaaggatggtaatacatacgcacatcttcccagtaatgattcaactgctggatattatcgacattaatttctggacaacgttcgccgttgactaacgcatagtaaaggctactcatacttggctggctagttgctccactgactgcagacatagcaacatcgacaatatcgacacccgctttggttgcggcagagtaagtgatgatgccattgccactcgtgtcgtgggtgtgcagatgaattggtacatcaatactcgctttcagttcactgatcaagcgatacgccgcttgtggtttcagcaatcctgccatatccttgatcgcaatgatatgtgcaccaagattttgcaactccttggccatatccttataataatcgatcgagtatttttgacgagtcggatcattgatatctccggtataacagatcgctgcttctgcaattttgcctgcgtcccttactgcttggatgcttttttccatttgcggaacccagttcaagctatcaaaaattcggaagacatcgattccttgcgcagcagattctttgataaattcttctaacacattatctggataatttgaatatcccaccgcatttgatcctcgaaacagcatttgtaacaatgtgttcggcattttcttacgaaacatacgcagccgttcccatggatcttctgtcaagaaacggtaagcaacatcaaacgttgctccgccccacatttcactggagaatagttgaggaatcccctcttctgtcaacgcagcgatcttcttgaagtcctgggtacgaactcgtgtagccagcaagctttgatgcgcatcacggaaagtcgtatccgttagtaaaacatttttttgctgattgatccaacgaatgacgccatcagcaccttgagtatctaaaatggttttagccgatacgaaatcaggcaatgtctcaatctgttgcggaattcttggatcattataaaatggttttttttgtttctcgattcccggaaagccattgatcgtaatctcaccgatatatttcattgttttatttccgcggtcgcgaatgcgaggaaactcaaacaattcaggagtattatcaataaatgtcgttttcgcttcgccagaacgaaattgcggatgagaaacaacattgcgcataaagagaatattggttttgactccacgaacccgaaattctttcaagcagcgcatcattttttgaatcgcttgatcaaatgtcgctgcatgggtacaaacttttaccagcaatgaatcaaaatagggagttacaacggcgccagcataggcattaccaacatctagccgaacgccaaaaccaccaggtgaacgataagtatcgatttttccagtatcaggcataaagttattggcaggatcttctgtcgttacacgacactggatcgcaaccccttcaaagtggatatccttttgttgcgggattccgatttctttgtgcaagtctttcccttgagcaatcaaaatttgtgtcgttacaatgtccaagttagtgatcatttcagtaatggtatgctctacttgaacccgaggattcacttcgataaagtaaaagttgtctccttctaccaaaaactctacggttcccgcattgatatacccgacatgtttcatcaactgtaccgcagcttgacaaattttttctcgttgggcagcattcattgatacacatggagcgacttccaccactttttggtgtcgacgttggacagaacaatctctttcaaatagatggacaacattgccatgactgtcccctaatatttgcacttcgatatgttttggattactgatgtatttctctacatagacttcatcactaccaaatgccgctttcgcttcgcttttcgctcgttcgtaaccttcacgggcttctttctcatcgtgagcgacccgcatgccgcggccaccaccgcctaaggctgctttgatcatgattggataaccatgggtttcagcaaacagcaaaacgtcatcaatagtgttgacgggtccgtcggaacctggaatggattggataccagcctcgattgcagctgttttggctttgattttatcgccaaagatatccagatggtgtgtcgaaggtccaataaaaatcaagccttcttcttcacagcgttgcgcaaacgctaaattctcggataaaaatccgtaaccgggatgaatcgcttcggcaccggcctttttcgcggtgcgaataatatcttctatgtccagataggcttcaatggggcgcttgccttttccgacaagatacgcttcatccgctttaaaacgatggactgaatattcatcttctgcagcgtagatacccactgttttgatgcccaactctgcacacgcacggaaaactcgaatcgcgatttctccacgattagcgactaatacttttttcatcataccactccattccattgatcaataattcaaactatattgtttcctcttttcttctgcactaatgttcaaaataaagccgatacaaatcgacaacattaacaaacttgatcctccttgactcaaaaaaggaaaagtgatccccgttaacggaatcaagccggtgatcccacctaaattgataaagatctgtgacataaataatgtcccgatcccaatacacatcatggaattaaaggaatctcttgatcgaatgccaatcaaaaacattcttcctaccatataaaagagaattcctaacaaaacgattgagggaatcaagccaagttcttccatcacgattgaaaaaatataatcggtatgggcttcattcaagaagcctcgtttttgaatactatttcctaatccgcgaccaaataatccgccattgaacatggcataatatccattgaccatttgatgtcctgtatcaaattcatcggcaaaaggattggtgaaagcggcaaatcgattgtagatatattcaggcagaaatttcccacctgtcaaattgacaaaagtaatcgccaaaaaactaaagagaactgtggccccacctaatatcagggtatacacatagtttaatccgctagccagcaaaaccacaaaagccagcatgaaaataataacagcgttcccgaaatcgggatagaaggccaaaatcaccgtataagccaatacgatcgccattggtcttctcacagaaccccagaagtcttgctggatgccctcttggcgataagagaatgtgaccgacaagaaccaaatgataataaactttaagtactccgctggctgaacagagaatcctgcaatcgagagccagccccatgcaccattccttttttggaagaaaaaggcggcgatcaaaagaaagaaaataacgatcatggcaatttggacaaacttcttattgcgaaagacatcagttttcatcttgtacatgatcgtgatcataatcaaacttaccacccaaaaaacggcttgattgatcacataagctgctgaagtagtcggtggctttgctgtcattgcgacatatgaggtcgaactgtaaaccatcatcaaaccagttacgcataaaataaggtaaggtattaaaatgctatagtctaaaaggtgtctttttttaactttttctggcaagattatgcctccttgccgatttcagtagatttttgttcttcatatacttcgctatacaattgatttaggtctttttccagatctgccatcaattgttggccagcagcattgtctacaatacccaagcgtgttgcgaaagcgacttgtcgtgataagccatacatttgtgtgtcaacgacttcctcgaatgctttacactgagcaatacacaaactattttcttgattgcgaatcaatcgtttgattcgttcggcatcctctaaaagcagattcaatgccatttctgaatcaatctgcgccattctggtccccccatttcttagtttcattattatagcatattctataccgatttggcacagtaggatgccataaattcaaccgtaaataacgaacataaatttttttttgctaacaaaaaaagcgaattatcgactgatataaaaaaaagaagtattttcattcgtttttttctgtttcattgggttccgctttgctttgtaaatcgtgaaacacgaaccaattgtgaaacattcaaagcgattcacttaataaggaaaaagacaaaagattgatccagcagcctttattgaaaaaaaagaagtggaattgtccacatgttctttcttcctttcaaaaaaagaacaggaagcgcaccgcttcatgttcttttgattactactgtttctgcttttcaccgataaagccatcaccgttaatgtcctcatctgataaccgttcgacttctttgatgaatccctgactaagttcttcgtaagattctccaacaactgcgtcatctggaatttgatctaggttagcaaaaaattcaatatgattatgcaagttggtaaagatcatcggggcatcgccgccgtattcaccatctaaattgatcatcaaacgatcttttgcatctggcgcatcgacttctaaacgagacgtttttgtatagatcaagcgtcggtcattgatatgtttgccaccgttcatcatcaatgcaatcagatgaacgatctcaaaaatatttgccgttttcactatgatcagcgaaaatttcccatcgtcaagtttcgcatccggggcgatttgttcaaaacctcccactgaattcgtcaatcctaggaagaacatcgaagcgccgccaatatattctccatcgtcatatttaaagtgcatcttgattggtttgactcgcggcaacaattctgcgccttttgcaagatatgccaaataaccgaacacactcttcaactctgaaggaacatcataggtcaactcagtcaggtgtccacctgcagcgatattgataaaataatcccgatcagtttttccaatatccattttgatcgtttgttccttgagaatgacttctgcagcagccttcacatcgtttctaggaatcttcaatgcacgagcataatcattggttgttccgcctgggatgatcgccattttggggcgcttttttagcggagcgataccattaactacctcattaatggttccgtcgcctccggctgcaacaaccagatcaaatccggctctccctgccctactcgcttcatcgcgagcagagaatgggagagcagtcgtcgcaaaagcactggcttcataaccggctttctctaagacttctaatatatcggcaagatgtttacgaatcagttcttttcctgatgttggattataaatgactctggctcttttcatattccgcctcttatcgttttgctaattcttcttgaagtaatttgttcacaacgccagggttcgcttgtcctttagttgctttcatgatttgaccaactaagaacccaactgcccggtcttttccgttcttgaagtcatcaacagattgttgattcttatccaagacttcattgatcattggcagaagttgtgctggatcggatagttggatcaatcctttcgctttgacaacttctttggcatcgccgccattggtgatcaattctttaaagacttttttcgcaatcttagaactgatcgttccatcagcaatcagttggatcattcctgcaagattatccggcgttaatttggtttcttctaattccaatttttcactgttcaagtaggccgaaacttcacccatcaaccagtttgatgcttgttttggttccgccccagcatcgatggttgcttcaaagaagtcggacatttctttggtcagtgtcaagaccattgcgtcgtattctggcaatccaagttcgttgatgtaccgttggcggcgtttttgtggaagttctggcaatgtttgccgtactcgttcgatccattcgtcatcaataacaaatttaggaatatctggttctgggaaataacggtaatcagatgatccttctttgacccgcatcaagattgtcttattagtggtttcatcaaaacgacgtgtttcttgttggatctcaccgccagaaagcaatacttttgcttggcgtttttcttcgaaagccaagccttttttgacaaaggacatagagtttaggtttttcaattcggttttggtaccaaaagcttcttgaccataaggacgtaaagagatattggcatcacaacgcatggatccttcttccatcttcacatcagatacttctgtaaattggatgatagagcgcaaagcttccaaataagcataggcttcttctggcgagcgcatatctgcttcagaaacgatctcgatcaacggcgtgccctgacgatttaaatccacataggaatagccgccgatgccatgcatatttttccctgcatcttcttcaagatgaacccgctcaatacggatttttttctttttgcctgctacttcgatctcgatccaaccatcatgaccgattggttggtcaaattgagaaatttgataggctttcggattatccggatagaaatagtttttgcggtcgaaatgagtatctttggaaatttcacagtttaacgctagtgctgctttcatcccaaattctaacgcggctttattcatcaccggtaatacccctggataaccccagtcaatcacattcgtattgctatttggctcggcaccaaaatgtgctggcgccggtgaaaagatttttgagtttgtttttaattctacgtggacttcaagcccaatgactgtttcgaagttcatgcgttattccctcctaaaatcactggttttttcgtatgaaaatcagttgcttgttcaaacgcataagccgcttgatacatcgttgcttcatcaaaatgtttaccaatgatttgcaaaccgactggtaatccttcagaaaatcctgctggtacagacatacctggcaatccagccaaattgactggaatcgttaagatatcattcatgtacattgtgattggatcattgatattttcacctagaccaaaagcaacggttggagatgcaggaccaataatcaaatcgtaatcagcaaatactttgtcaaaatcttgtttgatcaatgtacggacttgtccagcctttttgaagtaagcatcataatatccagcacttaatgagaatgtccctaacatgatccggcgttttacttcttctccgaatccttcactacgagaattgacatacacatcgtctagattttttacgttttctgaacggtagccataacggattccgtcaaaacgttgcaagttagagcttgcttcagaagaggcaataatataataaacggaaacgccatatttagaatgaggcaagctgacttcttcgactgttgctcctaatgctcggaatgtttctgccgctttcaacacagcttcacggacaccaggttgaatcccctcacccatatattcttttggcagcgcaactttcatacctttgatatcgccagttaaccctgcagcaaaatctggtactgctactccagcagaagtgctgtctttggcgtcaaatccactaatggcagacaatgccagtgcattatcttttactgaacgagtcattggtccgatttgatccaatgaagaagcaaacgcaatcagaccaaaacgtgaaacacgaccatatgttggtttcattcctacgattccattgaaagaagcaggctgccggatcgaaccacctgtgtcactccctaatgagactggtacttgcccagcagctactgcagctgcagaaccaccagaagaaccgccaggaactttggtatgatcccacgcattctttgtttttttgaagtaggaagtttccgtacttgctcccatggcaaattcatccatgttcaatttaccgactggtatcatgtctgcttggtagactttttccatcacagttgcatcatatattggttcaaagttagccaagatcttagatgcagctgtagtcagtaggtctttggtcacgatattgtctttgatcccaatcggaatccctgccaaaacattgctttcagaaatacccttctcatcaattgctttggctaatgccatcgcgtttgactcgttcaatgtaataaaagaatccacttttggttcagtcgctttgatttgctcgaatgtctctgctgtcaaatcgacagctgaaatttctttggaaacaagcatgccatggagctcttccaaacttttacttactaattctgtcattacgcaccggcctccccattatcaataattgctggtactttaatgaaaccatcttctgattccggcacattacgcatcaattcttgtcggttccagccttctgctgcgatatcttcacgcatcacattgattgtttcagcaacgtttgatgtaaatggcacaccttctgtgtctacttcctctaaggtttctaccatatcaataatttttcctagctgagaggtaaactcatgtaattcatcatctgagaatgataattttgctagcttggcaacgtgtttgacttgttcttcgcttatcgccataaaatcctcctctttctcgcatccataaaaatacgtttacgtttttccaatgtattgtatcacttttccagcaaatcatgaaatacattttgaaaattatcatacttaattgaaaatgtaggtctcgattttttctgccccatctttacgggcaataaaagcttgctgtttccctagagagccaacttggacttcgatctcgccaggaactcctttgaagacagattcgacttgctttgcgctatactgaacaaaactggtgatctcggttttactgtaataattcgactcgactttcaaaacaagtttttggagttgatcatctacgtaatacgcattgccggtcacaccactcaagtcaggaaagaaactaatgacagcatcacgaaatgttttgaacttattatccaaaccatcatcggtggcagcattggtgacccccgcagctacaggtaaaataatgtgggcctctgctactttctcatactgatcgatagttgttcctccatcttggctgactgcttgataaacataattgcctccggcgatatcatctttagcagcttgttcgaataaaccgatcacgataggtacagtctccaaccctttgatttttcttacttgtgtcaaaacagcattgactgtcttccgcgcgtttgccatccactcatcacgagagatagaaatggtctcgtcgctgccatagtagacggtattaaaggcaaagcctaaactaatacctgccaatgttttgccgtcttctttaataaaatcttgctccatcaattgttgaaaaataagcggctgatctgaaccggcagggttaagaccttgcgggttatcatcagagacacgtttcagccaattcttgatcgtatcagcaggaattttttgaccttcttgaaagtagcacgtatcgacagaaaaagtctgcttggacagcctcagcaagccattctcaaaattggtttgattgaacccgctgttcatttgctctgcattcaatcctctagcagcactcggttggtacttgccgtctgtcatgactgcctgatagacagaattatcgacacggccagtggtaatattaccgctggccgtctcttcaccttcgttgatattcgtgattcctttgttgagattgccgcaacctgacaaaaagcttaacgacatcgcgacgatcaagaagtgtttaatcttcatggttatggctcccttcaatcgctgccaccatttgattctcttcccaaactgtaatgcccaagctttgcgctttcgtcaatttactaccagcctcttctcccgctacgacgatatctgttttctttgagacacttcccgtcacttttccgccaaggttctcaattctttcctttgcttcttcccgagtgaaatgagtcaactttcctgttaagacaactgtcttacctttaaagggtgagtcaatagccgagagctcctcattttttaaaccaaggtaatcaaaattgacccctgctttctccaactcatctaaaagatcatggacttcttcgttgttgaaataagtgacaacactatccgcgatggtttgcccaatcgtttctaaagaaacgatctccgactcatccgctttgcttagattacgcagattgcgataatgttccgcaagaattcttgctgctttagatccgacatggcgaatccctaagccaaatatcaaacgctcaacagaattttctttactggcttcgattgctgacaaaatattgtttgccgatttttctttgattttgtctaatgtcaacaattgttcttccgtcaaataatataggtctgcaacatcagcaactaagtgcttttcatacatttgttcaagaactcgtgggcctaacccttcaatgttcatagcatttcgggaaacaaaatgactcaatccttctttcatttgtgcaggacacttcggattgatgcagcgcagtgccacctcttcatctaaatggaccaattcactgtcgcaaatgggacaatgggtaggaatcggatagggctcactggcttttgaccgcttatccgtcaatacgttggcaacttctggaatgatgtctcctgctttatagataatcacagagtcattcaagcgaatatctttggcgcgaatataatcgacattatgcaggctggcacgacttactgttgtaccagctactcgaaccggcgtcatgaccgctgttggtgtcacaacacctgtgcgtccaactgtccattcaatctcttcaatggtcgtttctgcttcttcgggtggaaatttataagctgccgcccaccgaggagctttaaccgtaaatcctagtgtatcttgatcggagaagtcattgactttgatgacaacgccatcgatttcataaggcagctcactgcgtttttcgtgaaattcttcgatatacgcccaaacttcatcgatcgttcggcacaaacgccgttcatgatttgtccggaaacccaaactgtctaattcatcaagcgctgagaattgatcgtgtgcctcgataggaccgaaatctgccagagtatataagaatgtgctcaaattacggctggcagcaatccgtgtatccagttgccgcaagcttcctgctgcggcatttcgaggattggcaaatacctctaagccctcttcttcccgtacttgattcaaacggatgaaagaagctttaggcatgtaacattcgcctcggacttctaatgaaacaggttctttcaattttaatggaattgacttgactgtcttcaagttttccgtaatattctcgccgactgttccgtcaccccgtgttgcaccacgcacaaaccgtccattctcatatttcaaagagattgatagcccatcgatcttcaattcacagacataatcaacggcacgacctagcgctttttggactcgcgcatcaaaagcgatgatttcttctttatcaaacacatcattcaaactgtacagaggaatatcatggatgaccttttcaaatccaggcagaacgattccacccactcgctgagtaggagaatcttctgtgaccagctgcgggtaatccgtttctaattgaacaagttctttataaagtcgatcatagacgtaatcttcgacagacggctgatccttcacataatactcataggcatattgattcaaagtggttcttaattcttccgctcgttgttgaacttcagttgatggcacagccatttcgattcctccttatagtttttcgatcggagcaaatgctgcaagcagccgttttactccttgttggggaaaagcgacatctaattctagatcctgggcggcccctgtggtccgaacgatcgtgccgacaccccattttttatggttgactttttcccccacttgccattgattgccggctgcagtcgtggtttgtctcgacgaaacagtggactgacgaggttgggtatacgttggtttgaaaactttaggctgaaaggaagcagctgcccctttcggctgagttctttctcccagtgactgcagaagatcttgttcaatctcttccacaaaccgagaaggacgattgtattgagtgcgtccatacaatgtacgagaaaatgcgtttgtcaagaatagctcttcttctgcacgagtaatccccacataagccaaacgacgttcttcttccagttcgctttcttccatcaatgctcgagataacgggaagatgttctcttctagcccaatcaaaaagaccacaggaaattccaatccttttgccgcatgcaatgtcattaatgtcacttgactgctttcttcttcataggaatcaacatcggaaagtaaagcgaggtcattgaggaagacagtcaatttttcttctggcgcatcggcatcatcttcattttgtgcctcaaagcgtttgtcaaattcttgggtcactgttaagaactcttccaagttctccagccgggattgtgattccagattgttctgattgatcaaatcttgtttgtaacctgttttatccaaaatttctttcgtcagttctgtcactgacagataaggaatcatttgggcaaactggtccatcatcatgccgaagctaccaagttctttgccggccttgcctgagatattggctaaatcgacattcatcgcagcttctaacaaggaccattcatgaagcgaagcaaactcacgaagtttttcgacagaagtcgccccgataccacgtttaggcacattgatgatccgttctaggcttagagaatcgcttgggttagcaatggccgaaagataagccaagatatcacggatttctttccgatcatagaatttgcgtccgcccaccattgtataaggcgcgtttgcttttaatagcatttcttcaatcacccgggattgagcattggtccgatacaaaacagcaaagtcgccgaatttacgtcctttatctgcaatttgtttttgcatctcactgacaataaaacgagcttcatctcgttcactatccccgcgatagtaagtgattttttcaccggctctattttcagtccacaaatttttgtctggacggttgcggttgtttttgatgacttgattcgcagcattcaaaatcgtctgagttgagcggtaattttgttccaacaaaatcactgctgcatccggataatctttttcgaagtccaaaatattttgcatattggcaccccgccagccatagatactttgatccgcatctcccacgacacaaagatttttgaagcggtccgctaataaattaacaagcgtatattgggcatgattcgtatcttggtattcatccacatggatatagtgaaattttcgttgataaaactgcagtgcatcttcattttccttaaacaagcgaatggtattcatgatcagatcatcaaaatccatacattgattatttcgtaattccttttgatacagcgcataacagcggcctacgatctgttcaaacaagctcccttgttgattttcataatctgccggagtcaacaattcatttttggcattggagatcgctcctaaaatggaacgcgggtcatatttttttggatcaatatttaactcttttaagactcgtttcatcaaagtgttttgttcagaggtatcaatgatcgtaaagtttctagagtagccgatctgatcaacatctcttcgtaaaatccggacacacatcgagtgaaacgtagagacccaaacatcttctcccccagatccaagaagctgattcacccgttctttcatttctctagccgccttattcgtaaaagtaatggctagaatattccaaggattgacatttttttcttcaatcaaataagcaatccgatgggttaagacccgcgttttgccactaccggctccggccattaacaacagaggtccttctgtatgcatcacggcctctttttgccggggattcatattcgcaagtaattcgtttttggatgacatggttttaaccatcctttctttctcaatccattcaattatagcattatccgattgtagggaaaaccgaacgccttgaaaagttgctaaatttttcttttttgtccttcaaaaaaattccttgttatctattcaaaaaagggctaaattaaataaggaaagtgaggagtttgatgaagaaacatgaaatccattatttagatacaacccgcctggcctttataggcaaaggaatcttgataggagcatttgtggggatcgtggttagtttgtttcgccttgcgattgaatggataggcgaaaaagttgctgctgtctatcgacaccttgctgatcatccagatcagatcatactgtgggtaattctctctatcatcactgtaattattgtgatccttttagtaaaatcagaacctcaaatcaaaggcagcggtattcctcaagttgaagggaagttaagtggcgagatcgattataattggttctctgtcctttggaaaaagtttatcgggggcattttatccgtcggatcgggtctttttttggggcgggaaggtccttcgattcaactaggtgctgctgtcggacaaggtttaagtcagttctttgaagccccaaagtcagaagaaaaaatattgatttccagtggtgccagtgcaggattgtcggcggctttcaatgcaccgattgccggtttgctgttcattttagaagagatccatcattccttttcacctcttgtatggctgacatcttttgcttcagtgatttctgctaactttgtctctttaaatttttttggattgaaacctgtcctttaccaaggaaagatcaatgacttgcctttgaaatattacggtgctttagtcatcttaggtatcttactagggatcttaggacgattttaccagtggacattgctgtctttgcctaaatggtatggaaaactacccatatcctctgactggtatggattgattccttttgtgctgattattccaatcggtctatttttaccagactatttaggcggcgggaatcaaattatcttgactttaggagaaaccggggctcccctgttgtttttggtcatgttgctgattttgcgttactgtttttccatgatttcatatggagctggactgcctggggggattttccttcctatcttaacattaggtgcgctgattggtgcgatctttggtacctttttggcacagtcgatcggtctggatcctatttatatcaagaatttcgtgatcgtagcaatggctggttattttacagcgatcggtaaggctcctttaactgctattattttagtaacagagatggttggatcaatcaatcacctaatgccgttaggactagttagtttagtagcttatatcgtggtcgatggtcttggtggtcatcctatttatgagtctctccttgaaaagatgcataaagaacccgctgtgaatatccgaggaacgaaaacagtgatcgagtatccggtaaccgcagaaagttcatttgatgggatggccgttcgagactttccttggccagaaaacatgttgctgatttccattcgtcgtggcgaaaacgaaattttgacccgcggagatacgatcatgaaagttggtgatgcccttttgatcttaacggattcgaatagtgtttcggaagtgaagaaaaaaatcagctatttagctgatggtcctctgacttaaacattggctgccaaattgccgtcaacatcctcctgtctttatttatcgatcagaaaaaaatcgaaggagcaaagctacagacacatgttctgcagttttgctccttctttcattgccatacaatcgctgtcgtataatattcccaaccgttctttctaaaatcagcttctgaaattagctatagtatttttccaccaaacgttcatccacataaacggaaacttgaccgtcattgactgggaaaattcctttacctgtttcgtctaagacaacttttgcttcattatttttcaaaatatctacgtaagtttcaccaccatgaatggcgctgatggtcatttctttctcagcaccttgggcattcgtcatgaccacggccaagccagacagttcgtgctcataatctcctgtcagtacccaaccgatacaatttgggtcatcgaaataatcaacttgattgccaaaggagattttttcacgcaatttcaggagattttctaaattttctccaactggttcaataccttgttcaggaataccgaatagatccccccagaaaacaactggtactccagcttttcgcaacaagatcaacgcataggcatgcactttaaaccagccatctacccatgactgtaaactctgaccgacttgcgtatcatgattatcgacaaaagtcacagcgtagtcttctcgagaagcagtcaatgtacctgcaaagatttgactcatatcgtacgcaccattcgaatgagatgcttcatagaaattgtaatgcagtggcacatcgaacagatggatcagatttccggaagaatcgagatactcttctagtttcggcagatcacccgaccaatattctcccaccacaaataaatctttgcctttttcttcccggcgattcaaaagccaattaacataataattaaactcaatatgtttgacagcatctaggcgatagccatccacattcgttaactcttgataccatttgccccatttatccagctgttcgatagtttctggattctccatatccaaatcacagcccattagataatcatagttgcccatctcatcatccacttgatcttcccaccctttttgggcaaagttaaacaaggcatgatcgttggttcggtcatcataatcaacgccagaaaaatttttccacgtccagacatagtcattgtatttcccttttcttccagggaaagtgaacttcgtccaagcttcgatctcttcttcatcacttatcggcttgttgcgattgtcccaactgtatttgaccgctggtgccgtttctttttcatcggctcctatcaaatgattgaatacaatatctgcgtaaacctccaacccctgatcttgcaacgctttgattgcctcaagatattcatctttggttccgtacttggttggtattgatcccttttgatcaaattctccaagatcgtagtagtcgtagacaccatagccaacatcttcgacgcccgctgtacctttatatgcaggaggcaaccataccgctgtaaatccataatctttaagctcactactcatttctttcaatctattccaatgttgactgtctgcaggcaagtcccattcgaagccttgcaatatcacttcattcttcatataattcccccctaaaaataattaagccaaagaatagccattcttgtcaaacattaacccatttcgattcttttctgagtaatttgccgaccgtttttgaccgtttaagaatgtattacccttacattttgattgtttttaaacgattgtgattgattatgactgttttatgtgctatcataacaattgaagaggtgatgtaaatgcttacagaagagcgtcatcaaaggattttagcccttttagaagaaacggatatcgtgaaagtcagcgaattgatccatcaattacaagcatctgagtccactatccgtcgcgatttacaagaacttgaagcacagggagttttggtccgaatccatggaggtgccaaaaagatccagcaccttggatttgaacccaatatgaaagaaaaaacgcaaaagttccaagtagagaaacaaaaaatcgcccaatatgccgtctcattgatcaaaaaggatgaggtcatttacttggatgctggaaccacaactttagaaatgatccctttcttgtcatcgatctcaaatgtgaaggttgtaaccaactctgtcaaacatgcggcattactgatcgatcaaggaatcgagacattgattttaggaggaacgatcaaaatcagtacgaacgctgtcttggggagcggtgccagtgagcaattgcgaaaactgcgcttcaatcgctgttttattggaatgaatggtgctcatgtagacgcaggctttacgactccagatcctgaagaagcaatgatcaaaaaaatcgcgattgaaaatagtcaaaaagcttatgtattactggaccattctaaatttcaacaaactacttttgctcaagttgctgccattgaagacgcagagattatcacagacttctgtccgaaaaactatgcggctaaatttcgaacacaaacgactattatggaggtatccgaatgatttatactgtcacactcaacccatcaattgactatattgtccacgtcgaagcattacaattgggcgaacttaatcgaatgaagcaagactttaaacttcctggcggcaaaggcatcaatgtttctcgtattttacagcggatccagatcccttccactgcacttggatttattggcggattcactggacgtttcattgaagattggctgatcaatgaaagaatcacgaccgatttcacacaagttgctgccgatacaaggatcaatattaaattaaaatctggcgaagaaactgaaatcaacggattagggccaacaatctcaaaggatgaaagtcagcaattgaaagacaaactgtcttctcttaccaaggaagatatcgtcattttttctggtagcaaaccaaatggactgacggctgactactatcaagagttgatcgccatcgtcaaagaagctggagccgagttcgtcattgacacaacgggtccagagttgttcgcagcattacccgaccaaccgttgctgatcaaacccaacaatcatgaattagcggaattgtatcaaacgacattccactccttcgaagatattttaccttatggacaaaaattaatcgctgatggcgccaagaatgtcattgtctcccttggcggagatggagccattttctttactggaaacgaaatctaccgctcgaatgttctgaagcgttcactgaaaaactcggttggagctggcgactcaatgattgctggctttatcggacaatatacagcaacaaaaaatgcactggaagcctttaaatggggagttgcttgcggcagcgccactgctttttcagatgatttagccacatcagcatttattcaagaattattgccagaagttgttattgaaaagatactttgacttaacataaggaggataaacaatgaaaatcaacgatttactcttaaaagatgccatgatcatggaccttcaagcaacggataaaaaaggtgtgattgacgaaatggttgccaaactttatgaagttggccgcatttcagatattgctgtctacaaagaagggatcttggctcgcgaagcccaaacatcaaccggtcttggcgacggtatcgcaatgcctcatgcgaaaaatcaagcagtcaatgaagcgactgttttatttgctaaaagtaaaaccggtgtggattatgaggcacttgatggtcaacctacttacctcttcttcatgatcgctgctcctgaaggagctaatgatacccatttacaagccttagctgctctttcccgcttgttgattgatccagaatttgttgagaaattaaagaaagcaccaactgcggatgcagtccaacaactatttgctgaagcagaagtacaaaaagaagaacagacagatgtcataactacagagtcagtgagtgatcgcccttatatcgttgctgttacagcctgtccaacaggtattgctcatacttacatggctgaagatgcattaaagaaaaaagccaaagaactaggcgtagaaatcaaagttgaaacgaatggttcggaaggcattaaaaatcgattaacagaagaggacattgcacgagcagctggcgtcattgtcgctgctgataaaaaggtcgagatggatcgtttcaacggcaaacatctagtgaatcgtcctgttagtgacgggattcgtaagacggaacaactgatcaatgaagctttaagcggtgatgctcctgtctttcacagtagcggacaaacagttgcagaagaatcttctgctgatggtacgtttggtcaacgaatctataaagatttgatgaatggtgtttcccatatgttgccattcgttattgcaggcggaatcatgatcgctatttcctttatggtcgatcaattcatgggtgtaccgcaagacgctttaaatcaattaggtagttataatcaacaagctgcttggttcaatcaaatcggtaatgccgctttcggattcatgttacctgtcttggctggatttattgcatcgagtatcagtgatcgcccaggtttgatcgttggttttgctgctggcgcattggcaaacagtggtggcgcaggattccttggtgcattgattggtggatttttagcaggatatgtcatcaaattcttgcgcaatcttttcaaaggtttacctaagtcattagacggaatcaaaacgattctcttttaccctgtttttggtttgttgattactgggttcctcatgctaatgatcaatgtcccaatgaaagcgatcaatgacggcttaaacagcttcttaacaggattgagtggaacaaatgccgctttactaggtgctctgttagcagctatgatggcagccgatctaggtggtccaatcaacaaagctgcctatgtgttcggtacagcaacacttgccacaacggttgccgaaggtggtagtgtcgtaatggcctcagtcatggctggtggaatggtgccgccattggcgatctttatcgcaacagttttattcaaaaataaattcactaaagatcaaaaagaagcaggtttgacgaatatcgtgatgggcttatcttttgttactgaaggtgcgattccttttgcagcagctgatcctcttcgggccattccaagtttcgtgattggttctgctttaactggtgccctagtcggtgcattcaatattcaattgatggctcctcacggtgggatctttgtggtccttttactatcaaaaccattattattcctattgttcatattaattggtgcgattgtttcaggaatcatcttcggtttgttaaaaaaagaagtaactaccgcttaatacatgttgtgtgaaacaactagcgtctcctatgcaaaaaaatctccagcgtgtttgaaacacactggagatttttttgcgagaatcattcaacttccttgtctttgctattttatatggctctatttatttccagaaatggattggtgttcagctaagcgttccatattcataaaatagacccgcaagcgatgggtttctttttttagattgacccaggtatattttttgctgcgatgcaataaaccaaagcgaacatctgacatacgatctttcaattcgtcgataggaatatctgtcatcgcctcttgcggcaaatagaactgcaaacaaacggtgtattcttcaaaatgttccgtagtgtaatccgcctctaaatgactgcgaatataaaattcataagcatctaagccattatcgagcgttaactgtggttttaagacaatgtaatccatcatccgcatgccttcttggtcgatccaagggaaataagcctgtgcattcaacaatcccctcacccgacgttcttggtaaatctcacgaactaaatcaaagttccgagtgataaaatgggtcgctttgcgtttgacggtgggctgtaaacgatcattttgatattggatcgtttggatcaactgatggccaaacgcgtattcaataaacggttctcgcaaaatccctactccgttatcccaagtaagttgatccaccccgatttggtcccgaaacaaacgttgataggaaaggttggcaggatgatcccattgaaacggatcacggtaaagctccaccatgacaaccccttcctccatcgtttggatttgttctacttgttgggcatctttaataatcactaacggcaacactcgctcatagtactctgagaaatacatgcgccaacaggaagttaaacaaaacccgttataaaaaacatcatatccggcaaattgattgcaatcgatcacgatttctttggcatggttttttcgctttggtaattcagcgatttcttctggtttctgaaagttatagcgtttctctacactttcgacattatgattgaggaattcatcataagctcgaatataactaaagagaccgccttgttccattgtggtctttatataactcagtaatagttctcgcgatccctgaaaaacatcaaatgtaaaaagatgtcgttgcagtacggcttcttggacaacgtgtatactggattcattttgtccatcggttaaaatcagttcaaaattgacctcgtcaatacttccctccagcaatgagcgtacttcagcgatatcataggagtggatttccttttgatttaaatagtagctggtgggggtaaaggaaagacggaccaaagcgaaccagttggctatttgttcacgcatcagagcatcggcgagttgtgccgattgaataaaggcatagattttcttcgttttgatcatctttctcacctctttatgtacttcttattttattatagtaaagggattcatgattgaacactatttcgcttacttttgagatgaaaaactttggttttcatggtaaactagaggcgcttggaggtgggaatatgggattaaaattccaacgtgaagattctcttgataaaatgttcgatgtgtttgctattcttcccgacaatgacaaaaaagagaacaaacccgacatcgaacgcttcttgaatgcgaaagaagataaagaagaaactgaaaaaaatacggatcttaaaaaacaaacaaaaaaaacatcctaatcgatgttttttttgtttgcacagaatttttccgataaaagatgttccggagcaaactttctccgtttattttctagtcctgagagattgccccatgcatcttacctcttatctattattgcttgatggccgcttctatcgcttgccaagcttcttctttcccctgtttagtgatggaagaaaaaagaataaaggtgtctgctggatcgaattccagcgcttttttgatcacactttcatgcttgttccatttcccgcgaggaatcttgtctgctttcgtggccaccacgattactggaatctcataatatttcaaaaactgatacatttgaatatcttcctgagaaggcgcatggcgcagatccactagagagacgactgcccgcagctgctgtctctctgcaagatacgtctcgatcatcttcccccactttgcccgttccgtttttgaaacttttgcatagccatatcctggcacatccacaaaatgcaaggtgttttcaatcaagtaaaaattcaatgtttgggtcttaccaggtttcgaagacgttcgcgctaaattttttcgattaatcaatgtattgataaaggaagacttcccaacattggaacgacccgctaacgcgatttccggtaaatgcgtatccggatattgtgccggtgaaacagcactgatcacaatttctgcatcatgtactttcatctgctcgctcccttctaataaaatctcatatgctttcagaaagaaagtcggatagtcatcaaactatccgacttactaaaatcaaactgctttttttgtttcttcattataaatgattgtcggttcaccgatttctttggctgcatcttcggtaataatgactttttcaatcgactcatcagaaggaacattgaacatcacgtccatcatgatattttcgataatcgaacgtaaaccacgagcacccgtattgcgttcgatcgctttatccgcaatcgcgcgtagagcagctggttcaaactcaagctcagtatcgtctaatgctaacagtttttggtattgtttgactagcgcatttttcggctccgtcaaaatacggaccaagtcatcggtcgtcaatttgtctaaagctgccataaccggcaaacggccaataaattctgggatcaagccgaatttcaacaagtcttcaggaatgatatgttgcatgatgctttcatcttctgagaaccgtttgttgttcgttccaaaaccgatcgttttttcacccatccggtttttaacgatggtatcaatcccgtcaaatgcaccaccaacgatgaataaaatattcgtcgtatcgatttgaatcatttcttgatgaggatgcttccgtccaccttgaggcggtacacttgcttgtgtcccttccaagatcttcagcaacgcttgttgcaccccttcacccgatacatctcgcgtgatcgaaacattttcgcttttacgagcgattttgtcgatttcatcaatataaatgatgcccttttctgccatttcaacgttatagtccgctgcttgcagaagtttcagcaaaatattttctacatcttctccgacatatccagcttccgtcaagctggtggcatcggcgatagcaaatggcacattcaatgaacgggccaatgtttgagcaaggaacgttttcccagagccagttggtccaattagacaaatattgcttttttgcaactcaacgtcttctgcggtcggctcaacgttcactcgtttgtaatgattgtaaaccgctacagcaagtgtctttttcgcacgatcttgtccgatgacgtaatcatttaatatatgcagcaattcttgtggtttaggtacctcggtaaattcacgaatggcttcttcgtagaactcttcgtcaatgatctccttgcacaagtcgatacattcattacatatgtatacaccaggaccggcaacgatcttctttacttcctcttgcgtcttcccgcaaaaagaacaacgaacagcgtcatttccatttgtgttgtcgtacatactgttcaccccttgataaatttctaacctgtaaaggagtggaattggttttactatctttacagtctttaatcatcttatcataactcatttgaaagaaaaagctatttctcatggccgttacgttttcttagcaattgaccacgtccgcaaaataagtcaagatcctcctgctcaaaaaggcaaagtaagcaaaaaacgatcgtatgaaatatacacaccattgctttttgatcaatcaaaaagggcaaacatcggaaaagacgtttgccgctcttttgatgaaaattaagcttctttcgccgtaccagttacgatttcaacggctttcttcattgtgatgtcatgtttcaacatatcttctgtcaagacgcgtttgatttgatcaacaggcatgttgtaagcttctgaaagctcttgaatttctttttcgatgtcttcttcagttgcttccaaaccttctgcttttgcgattgcttcaatcacaaggttagttttcacacgagtttctgcttcgccttcaaattgttgatgcaagtcagcttccgttgaaccagtcaattgatagtacatttctggtgaaattccttgacgttgcatgttgttcaagaactcatccattgagcggtgaacttcgtcatggaccattgaatgtggtaattcaacgatttctgcgttttcaactgcttggcgaatcgctgcttcatcttttgcatcttcagcagctttttcttttgtttctgtcaattctttgcggtatttttcttttagttcagcaagtgtttcaacgctatcatcaacatctttggcaaattcatcatctaattcaggcaattcttttgctttgacttcgtgaactgttactttaaagaccgcatctttacctgctagatcttctgcttgataatcttcagggaaagtgacgttgacttctttgctttcgccagctttcactcctactaattgatcttcaaaacctgggatgaaagagttagaacccaattctaatgaatagttttcgcctttgccgccttcaaatgtttcttcacctaagaaaccttcaaagtcgataacgactgtatcgccattttcagcagcttcgtcttctttgatgactaactcagcttgtgcttcttgttcacgtttgatgcgagcatctacgtcttcttctgttacttcacgatcttgtttttcaacagtcaactctttgtaatcaccaagtttaacttctggtttcacagtcacttctgctttgatcacccagtcttgacctttttccatgctgtcaacatcgatttttggttgtgatactggatcaataccagcttctttaactgctgcttcataagcttctggcaagacagcattcaatgcatcttcatacaatgcttcttctccgtacatacggttaaatacttggcgagatacttttcctttacggaagccaggtacgtttaagttgcctttcactttattaaatgcagtcgtcaagcctttttggatttcagcttgctcgatcgaaaatgtcaatacaccatcattggtgcctgttttttcccattttgcagtcatttatttccctccgaataacaattatattttacatatgaaatagtttcatgcatacctttaaatagtacactaacgttctttaattgtaaacattttacctagaaacttctcgtttttttcttgagtgatctgctttcagaattagaaagaacccaaaatctttcgtaatcttgttttcttacgttggatctcctcgtcgatcgcttgtggttcgctttttgcaaaaagatcttgatactcatcgatatagctttgtacccagcgatcaatctcttgggtttctggcaagaacggatagcttaaagcaaaatgatcattcaactcttctaaaatgccttctgctaaggttggattttcttgcccgattcgttcattcacagcttgtcgcatttggctgaaaactggcacttccctcaataaagataactgattgggaatgatctgccgttgatcccccatgtagtctatcaattcaaactgctgtgaacttcctaaacggacaagttcttctactagttttggtaacaaaaaaggattcgttaactgaggaagcagctccgtcatcaacgatacaaactgatcctttgtgagtccttgggaaaaaacgtgccatgtgtgcccgctaactggttggttgctgctgtccattgcaagcaatgactgtttttttcctaaaaaatcttccaaaccaagtatttgttgaacttcttctactttatccaattctttcactaaagtttcgcttgccgcttcagagatcaccggaaattcctctgcgagtcttatccattttctcgcttgcaagtattgaccatcaagaatcaacaaatgaccaatttgaacaaaaccatttggatcttgtaggtattcatccaagaaatcatctgccacttccaacgcttttgcaaaatcagccagttgctgtaagcacttaacgagagactgattgatctcaaaagaagaatgctcagtataaatttcctggtaatcatggtaagccttcagataatcttttgcctgatatgctttttctgctgaatgacgcaggcagtcttcaggttttggaaactggatcgtgtctcccatatctcattctcctttatctgtaatcgatctgcaatcgcacttccgcttgtatggtgcaatcttctggtagcaagaccgcttttcaacgggtcagtcttcgtttgcctcaaatagagactgaccgctcattacgctattgtctattcttgttacatattggcatttgcctgtttattgaatgctttaatcaaattgatagtaaccacactggtctcagaaaaataatctccggcatgctgcttttctttagtaaaaatcactggcaaataaccgcaataaaagaaaggattgaattgcaaaacgtagcgcatacacagttctcttgtcagaactgttttccaactcaaatcagcttctgtaaatgacacgacccgaataccgaaaatcatcttacctaccgtttgtccctgattgaactttgttaataaaacaaaatagcctaagtagatggccaacgagagtaactggtagagtccaaaaggatgcccgctacttgaccaaccacctaagtgatagatcgtatccagagtaattcctgtaatagctccgatacaaagtacatctacgagataagcaaatagccgaatccaaaacccagcaaaaaagtaatctggaaaatcattcactcgtctgcgttctttctgtttgtcttctatcccctcataccgttgccattctttttgtcgctgatcaatctcttcctcgctaaattcttttctcttaaacgagcccaatacttgttgatagaaatcatctggatgattcgtcacagcggcctcttgatttggggtatccacagctagttgtgcttcttgattcgcctgctctgtagagattccagaggtcgactctagattttccagagttacgttttctgctccctgttcaacaggttgttgtttgattcgtggctctttcgtttctttttcaggcatagttattcacctccataataataaagaggtttcggcgcatccatcgtacccaggctttctactacttgcaaaagacgactagactcagatgccttcagcccttgaaactctgccagctttgaacccagccatgtagaagcgaaccctgtggaaccgacaccatattcaaaaatttccgcatcctctaacccttgatctgcttctaatgcagcgaaggcgtcctcaggaaacccaatttcgtcaactaacccgttctccacagcttgttgaccatcataaatccgtccgtcagcaatttttctaacagcttcttctgacatgcctcgtccttcagctacaatggaaacaaagcgtccgtatgcattatccacgtaagtttgcagaactttcttgtcctcatcggtagcggctcttgtagaggaacccatatctttcaaggcaccacttttataggtgctatcttcgatccctaatttatccaataaacctgaataattcaatccagacataataactccgatagaacctgtcacggtttcatctgtggcaaagattttgtccgcacccgctgagacataataaccaccgctagctgcggtgttcttcatactaacatagacaggaattccaatttctttgatctttttcatttcacgagcaatctctgcactttcgtaaactccgcccccaggcgaattcacttcaaatagaatccctttgatcgttgggtcctcttgcgcggcacgtaattcttccagaaataattgatgatcatatccttctgttgagaacaatccaccacctgaagtattcgcaatcgtcccttccaaagtcaagcgaaggatgcggttattgctatctccagccgctatttgatgttcctccaattcattgcttccgtataaaagagcattcaatccgtccagtgacgactcttcatttgctggcggagccatcaaagcaaaaacacctgagcacgcaaacaatccaattgcaatcgcaacagccacccatcttctcttattcatttttccactcctttttaatagcggttctcaatcacaattaccgcttcaactagtccacttgcatcgaatttttcgcttttttctttcaatgcgtagccgccgaaatattctttagttaattcatcttgcactcgaaacgcttgtgcttcttgaacagagattgcacccggaagaatttcctgcaggctgtcccaaccagtgtctaacatgatttttgtatcatcattgacattttcttgtttctctaatctttccactatttcctttaactcggaaaacgtcatacattgtacagtttctgacatcttcatccctcactttcttctgtcattgtatcgaaattaaaaaaaaaaggatagtcaaaaaggacaattccaattttacgaattggatcatccgcaattctccttctttaaatctccattacagaacaaacattgcctctgataacatctataccaattattttttttagctttttctattgactaacgcccttataaatattatgataatgcatgtatttctacaaaataatttaaggaggatagatagaccaataggaatagcgccagatctgtacaacagatgacgaggaaagagtttatcgaagttttcggcgggtaactctagggactgcactctataagcaagaacaaaacctcatcgtgagatgaaaacaaacctcttgctgcgcaggtagaaatacataatgaatcgtaaataagtagtggaaagtaggatttgtcattatgtgtggaatcgtaggaattgtaggaaaatcaaatgctgaacaagtcattttgaatggtttggaacgtttagaatatcgtgggtatgactcagcaggtttatatgttgctgatcgtacttctggccacttagtcaaagcacaagggcgtatcaaaaacttggaagacaaagtcacaccagaagtaacaggaacgatcggtatcggacacacccgctgggcaactcatggtaaaccatcagaaaaaaatgcccaccctcatacttcttctaaccaagaattagtactggttcataacggagtaatcgagaattttgaagaattgcatcaaaactatttaaatgatcatcacttcgaaggacagacagatacagagattgtcgtccacttgatcgaagtattgaaaaaaaacctttcgactaaagaagcgttcaaaaaggcactctcattgattcgtggttcttatgcctttgcattagttgataaaaatgaccctgaaaccatctatgtagcaaaaaataaaagtccgttattgattgggcttggggatgggtttaacgttatttgtagtgatgcattggctatgctggatcagactactcatttcgttgaaattgaagacggtgaaatggtaactgtgacggcagaaacgattgaaatcgaagacctaaaaggaaatcttgtttatcgcgagtcttatgaagcacaacttgatttaacagacatcgaaaaaggaacgtatccttactatatgctgaaagaaatcgacgagcagccagctgtgatgcgtcgtctcattcaagagtatcaaggcacaggagaagtgacgatcgatgacgcattaaaggatcaaatgattgcgagcgaccgcatctacatcgttgcttgcggaaccagtaatcacgctggttgggccgcaaaagcgattctagaatctctgacacagattcctgttgaagtacatttatcaagtgaattcggctacaacatgcctttgctgtctgcaaaacctttctttatttttctatcacaaagtggagaaacagccgacagccgacaagtcttggtaaaaatcaatcaaatgaatttgcctagtctgactattacaaatgtagcaggctcgactctttctcgtgaagctgaccatacattgttacttcatgccggacctgaaatcgccgtagcttctaccaaggcctatactgctcaaatcgcagttttaaccttattagcaaaagcaatcggtgatgctaaaggtattggtgctgcacaggacttcgatgttttccatgaattaagtattgttgcctctgctatggaaacattagttgatgaaaaagcagtcatcagtcaattagcagaagattatttgtctgttagtcgcaatgcgttttatattggtcgaagcaatgactattatgtttccatggaagctgcactgaagctaaaagagatttcttatattcaagcagaaggatttgcagctggcgaattgaaacatggaaccatcgcactgatcgaagaaggaaccccagtcatcggaatcatcactgaagaagtgaccggctcccatacgagaggaaatttgaaagaagttgagtctcgtggcgctcatactttagtcatcgtcagccaagaactagcgaaagcgacggatcacattgttttgccttcggtccatccattggttactagtttagttgccgtgattcctacgcaactgttggcttactttgcaacattgcaacgagggtatgacgtggataaacctcgaaatttagctaaatcagtgactgtcgaataaaacttttaaaagtttttaggcagaaaaaagagctgcgacaagacgattgtcgcagctctttttttcgtacaaccaattaaaagcaatttttttagacaagctgaaactgcttggaattgcctattttgatcatcctttcttttctcgtccctcaatttttttaaagtcttttaagtaatgcacaaaacagcaagcagcattcatcccagattcattgcacctctgttgatcaacataggagaaatgtatcatttttttacacaccacgtgccatttatgatgattatccctactatcgtcagtaaactagttgcaacgaataaaatattccccattaatgaccagtgatcactaaaaagtaatgaaagcaggatgaaagcacccagaaccaacataccgatgccattcgctacatacaaacgatctaaatcatactgtgcctttttttcttcagaagccatattgtatccagcaatcaattgccatccatgtctgcttaaaaataggatacctgtaataaaaaacaaacccacgactaaccatcctgttgtatttcccatcacacattcatcctctctacacgtctgcctaacgtttagatccattcaccaatcggtttcttgcgctttatacagtgagtataccacatgaaaatcattatttggattatcattatattttcacaagataaaaaaaccaacgaaaacgactttcgttggtttctgatctcatttattccgcaccgatttcttcccgtacgacagctgcgattttatcgacataataatctactttttctgttgttggtgcctcagccatcacgcgcaatagtggctctgttccagaagggcgtactaagattctaccttccccattcatttctgcttctgtttcttcgacgatttttcggattgccggtacatccatcgcgccatttttatctgtcacacgaatattaactaatttttgcggatagatcgtaacttcacctgccagctcagaaagttttttcccagtctgcttcatgatattcaataactggataccagacagcattccatcccctgtcgtattgaagtctaagaagatcatgtgtccggactgttccccgccaaagttgtagtcatttttgcgcatttcttctacaacgtagcgatcacccacttgagtaatcacatctttcaaaccaatggcttcaacagctttatgaaaacctaaattgctcatcacagttgtaacgatggtatcttgtttcaaacgtttttgttcagctaagtattttgcacaaatgtacatgatcttatcgccgtcaacaatattaccttgttcatcaatagcgatcacccgatcaccgtctccatcaaaggctagtccaacatcggcccctttttcgacaacgaactctgctaatttctcaggatgagtggaaccaacaccatcattgatgttcaaaccattcggcgaagttcccatggtataaaaatcagtttctaagtctgcaaacaaccgattgacacttgtagcagtcgccccattggctgcatctacacagacggtgatgccctctagatcacccgggatcgtttgacggagaaattgggaatacttcaaaagaccttctggaaattcatcaacggttcctaaaccttcagctgacggccgtggtaacgtatcttctgcagcatctaataaagcttcgatctccgcttcttgttcgtccaccaatttgaagccatcattaccgaagaatttaattccgttgtcttgtgctggattatgtgatgctgagatcattactccagcactagctttttggacccgtgtcagataagccacacccggcgttgagatgacgcctagttgaaacacttcgattcccacagatagcaaaccagcgatcagtgcattttctaataactgaccagagattcgtgtgtctcgcccaactaagacgcgaggtcgacgatcgtctgtttcatgttgactcaatacatatccgccatagcggccaagtttaaatgctaattctggtgtaagttccttatttgcttctccacgaacaccatctgtaccaaaatattttcccataatgtattaccctctcttattctttactctcatctgaagttgtaacagttgtttcgctttctgaatcacggttttcttcactagtagatgattcactagtttcatctgatcgagattcggcagatgactcgttgccagtttgaccattcgtttccgttgattggaaaacaggtgtcacttggatcgtcactactttaggatcaatcgtcacaccatctggcactggcacttcaacagttcgctcaacagttgaggtgattcttgaaatatcgattggtacgccaatttgatctaatgtatctaaaatagactggctaccagaaatcgttccgctgattgcactcattctatagataaaatgggagatgccgttaggaactgttccttgctgggtgacgaataattccacttgttttgtcggggcttctaatgttaccgttacgttaactgtttcgggatctggcaaaattgctaatgcatttttagcggtatcccacgcttgtatcgttcctttgactgttgaagaggacgttccgatctcattaggatcaatgacagccaccacacgatcgatatcatttaaggtgcgatcacccgtagtgatcgctactttctgaggatctgcctctagagaagcgatagaatacccttcctttatatctgcgcccgatatgactggttcaacagtaaatgtttttgttactttcttttcaatagtcactgtgatggtcttcggctcgatttcagctgttacacccgaactcaaattctgaacttctaaaggaacttcatgcgttccttcccctaattcagagagatccgccatcacgcgaaagtttcgtgtctcatcatttttttctgcattcaactggatacgatttcgacttttcaaggtgacattcacggtggtttcatacccttggataaaatagctatctgtatcatacgtcgtttggatgggaacattgctaagatgttcttcataaccactagtagagccggatagattgacttgcagtgtggaaccactagcaataaaaaacaacaccaaactaaagaacagcgctagtataccataaaaaatatttcgttggcgttctttcttaatcattttcttccccctttgttcacaccgtcaaggaaagattgcagtagattacgttttgctgttttttcttcaggcacaagctctcgattcaaaatatccaagtattgttctcgagataacccagataacaattggttgttcatagtgatactgacatccccagtttcttcagacacaacgatcgtcaaagcatcactgacttctgacacccccactgccgcccgatgcctagtcccgaattctttaggaatcaacaagctttctgaaaggggcagatacgcactcgaaaccgcaattttgccgtctcgtataatgactgctccgtcgtgcaaaggtgtgttgggaataaaaatattgatcaatagttctccggtaatatcggcatccaaggcaatcccagtttcgacatactcttccaaaccggtagttcgctcaattgtaatcaaggcacctattttgcgtttcgccatatactggatcgctttatctaaagattggaccatcacttcgtcttcgtgcttttcagacttagaggtcttgaatagcgaactccgacctaaatgttccaaacctcgccgaatctccggttgaaaaatgacaatagcagcgatcaccccataggtgattacttgatccatcagccatgagagagttctcaaaccaatcaaacccgctaaaaaacgtaagacgataaacagcccgacccctttgaatagctggatcgccttggtccctctgactaactgaatcaatttgtagaccacataccagacaactaaaacatccaaaacattgattaaaaacgaaatagaaaatatattaaacaagaaaacttctctccaataatcaaaattaaaaaaatcactgaaattcatcgacataaacagccttcctttattcttaagacttcaaataatagtataacataggacttcttttaacacgttgaaaaaaagcaaatttatctcattttttcaaaaaaaatctcacttttttctggactctcgattattggataacacggttgatctttacgtaatggagcttaaaaaaaacagctctgccagatactggctagagctgtgacacttgcctattctgatttttttctccgctccgctctggcagctcttcttgccgcgcgaactgcttcgacttcaggatcagagactgatctacgctgtttagttctaacagattctccttgtttttccaccgattgaggttctgcttcagacaatggctctttttctaattttgctcgaatcttttcttcttgcccagcaagacgcgcataattatagaaacggtttttggcatccaagactgtttttgtgaataatgcacttgcagcacttgggttagctgcacctaaggctgaaaaacgaacctgtgttttcataaacgttggcatcaacgaaaaatcaggttttttatagtctagtgtcattgctggcttacctttttcagtcattaatgggttgtaacggtatagagaccaataaccggaagccactgcttcttttgcttctttgatggattgtctcatgccacctgctaatccatgggtgatacatggtgtataagcaatgatcagagatggtccagggaatttctccgcttcttcgaaagctttgatcgtctgcatttgattggctccggaagcaatttgcgccacgtatacatgaccatatgtcatagccatcatccctaaatcttttttcgacacatatttcccactagctgcaaacttagcaatcgctgaagttggggttgctttagagacttgcccgccagtatttgaatagacttcattatctaaaactagaatatttacatccgcgcctgaggccaagacatgatcgattccgccaaatccgatatcgtaagcccaaccatcgccaccaatcatccattgacttggctttacaaacaagtcgctgtcgtcaagaatcgcttgcaaacttggctgttgatgaatttcttgttgtaaagcagcctgtaattttgccgccctctgttggcttcctgcactttcttcccgatgatcgatccagtcttgcataatcccttgtagatctatcggaacagtgattaaggctgccttcatttttgctgctaaggcttctcttcgtgtttgatttgctagaaacatcccataaccaaattcggcattgtcttcaaatagtgaattggaccatgccggtccttgcccttggtcgttggtcgtataaggagacaccggagcagcgccgccccaaatcgatgagcagccggtggcatttgcgatcatcatgcggtctccgaacatttgagtcaacagtttgacatacggagtttcgccacatcctgcacaggctcctgaaaattctagaagcggtttattgaattgggtgcccattacggtacccggttttgccggattctctttctgacgtagtgtcatagcaaaggcccaattcattgcttgctctttttggctttcataagagctcatgaccaaagctttgtcctttgcgggacacgcttcaacacaaagcccgcagccagtacaatcttcaattgaaacttggattcgatacttctgaccatcttttcctcgcatttcttgaacaataaacccttctggtgcctctgtcagttcatcttcatccactaagaaaggtcgaatcgctgcatgcggacaaacaaatgcacattcattgcacatcgtacaacggtcggataaccattctggcacttctaaagcaatccctcgtttttccactgcagtggtccctagaggcatcgctccttccgtcatttgattccgaacgagcgtccccactgataattgattgccttcctgtcgattgattggctcaacgatctcccgaacataacgggatgttgcagttgatttccgttcaggcacatcaatgaaggcccattcagctggcacttgaatctcgtaaagcaattcaagggtccgatcaatcgctaaatagtttttttcgacaatttccatggacttatgtccgtaattctttaatacctccgcttttaaaatcggcagaacctcgtcgaaaggcataatatcagacaaatagaaaaaggcagtttccattgccgtgttgatgcgtctgccgagcccggtctccattgctaattgcatggcattgatggtataaaaacggatgtcattttctgcaatgtaacgcttgatgtgtttaggaagactagttgcaatttgttgctcattccaggtggtatttagtaggaaggtaccgcctttttttagccccttcagcaaatcatatgtatgcagatacgcaggggtatggcatgcgacaaagtcagcatgctcgatcaaataagtcgagcggatcggtgtgtctccgaaacgcaaatgggagactgttaatcctcctgattttttggaatcataataaaaataaccttgaacatacttatcagtgtgatcgccaataattttgatcgctgatttattggcacccacggttccatcggagccaaatccccaaaatttcgcctgaaatgtattgggattggtcaagtccaaagtagcttccgtgttcaacgagagatgggtaacatcatccatgatcccaatcgtaaaccgtcttttttgctcactttttggtttcgtcagttcttcgtatacagcaacgatttgatctggcgttatatcttttgaacccaatccatagcgaccaccaatgacagctggccggatcgctgcatcataaagggcactttggacatctaaaagcagagactcaccgtttgctcccggctccttgctacggtctaaaacggcaattgctttgaccgttgatggaagtttttccaaaaagacttccaatggaaatggtcgatacaaatgaattgtcaagaccccgacttttcttccttgtttgagcaaatgatccaccgtctgttgtacagtctgagccgaagaacccattgttacaattacttcttctgcatcagcacagccataataatcgaccaaatcatagttggttccgcgcaaatcattaatggctttcatgtatttgcgaattgttgccggtaacgcatcgtaatgggcattgaccgtttctcgctgttgaaaatgaatatcggggttttgattcgttccgctaaccgttggatggtttggattcattgccttttcgcgaaaagctgctaatttttcttgatcaatcaattgagccaattcactgtattcaagtacatcaatcttctggatttcatggctggttcgaaaaccatcaaagaaattcagaaagggaatcccactttcaatcgccgctaaatgagccacaggtgcaagatccataacttcttgaacactgctttccgccaacatcgcaaagcctgtttggcgagccgccatcacgtctgtatggtcaccaaaaatattcaatgcattcgtagtgactgctcggctggcaacgtgaaatacgccaggcaaacgttctcccgcgattttgtacatatttggaatcatcaacagcaatccttgcgaagctgtataagtcgtcgttaaagccccagtctttaatgaaccatgtactacaccagctgctccggcttctgactgcatttcaaccactttcactggttgtccaaaaatatttttctttccgctggcggaccattgatctaccaattccgccattgttgaactaggggtaataggatagattgcggctaattctgtaaaagcataagaaatgtaggctgccgctgtatttccgtccattgtttttttcttgcgcatctctctaacttcctttatcttccattttgagcattctcacacaatccattatagctgaaaaatctacttgaataaatactgcaaatcaaaatagcagcgatttagtgaaagagcaaacgatacagtttctatctaatctaagattttttcacaaatttcatttggttgtttctccttttctttctagttgaaattctgttaaacttaaaaaaaaggaggatgaaacatggatatttcaattatcaaagctaaagaaacaaatacgactactggaatcaagattggtgatgaaaatgctaagccaatcattgaattcatgaatcttcgttgtccttattgccgcaaatggtttgaagagtcattgccgatcctaaccgaagctgttgctgcgggaaaagttcaacgagtgatcaaattattcgataaagaaaaagagtctcttcaacggggaaatgtgatgcatcggtttgtagcaacggataatcctgctcaaacgatcgcagatattactaaaatctatcaaacacaagatcaatggggacatttaactttagaggaggttgcagaatttgcgcaaaaccagctaggattaaccgaacataaccattccacgtatgctggtgaaatcgtggaagaagcccgaaaagcaaatattcaatttgtgccgaccgttatcgtaggcagtcacattttcgatgaatcaatctcagcggatgagttgacacaattgatcaatgaataaaacctgtgccacagttctaacagcaacccactcttgaaggataatcgactcgcacgtgcggtccaacgaagccaaaactacttgatacttagccgttttagcttcattctatcccttcaactgttgtcttgttatgacctgtggcacaggttagtttaactgactttatctcgcaaacgatccgcaaattcattgattttacggattcgatggttgatgcctgatttggagatcgctccagaaggaatcatctctcccaactccttcaagctgacttcaggatgttccaatcgcaattctgcaatttcctgcagcttctctggaagagctcccagccccacccgttgttgaataaattcaatattgtcaatctgtttggaagctgcatcgatggtcttgttcatatttgctgtttcacaattcaccaaacgattgactgaattgcgcatgtcgcggacaatccgaacatcttcaaacttgagcatcgaattggtcgcgccgatcaatgtgagaaaatcggcaattttttctgcgccctttaaataagaaataaagccatttcgtcgttcaagggctcgcgcattcaatccataatagttcaacatatcgcagatatcttgattgtgctcttcatagatcgaatagatttccaaatgatagcggctggtctctggattgttgactgaacctgatgccataaatgccccccgtaaataggaacgcattttttgggcattccccataatttcatccgatacatgactatgaaacatcaatccatccataatatctaaatctagcaatacacgtttggtctcttgttttaagcgaacgatgtaaacattgttctttttcaacttcatttttctacgaaccaacagctcacttcggacattgtagtgatctttcaataaggaataaatccgccgagcaatggcagcattttctgtttgcacattgagaacgaactgctggttgttaatacttaacgatccattcattcgtatcaaagcagctaattctgcttttgcatgttcccgatgtacttctagtgatgtcagttcctttttgacttctgctgcaaaggacatagcgtcgcctcctttctagattttggcaccgtagacgatccgcagtaattcatcgatcactttatcaccgtcatgaaagacaccgccatcacgtaactctaagaaatccgctgaaaccacgcgacaactttcattccgcagtccttggaagtcatgtttcacttggacaaggtattcatcgtagatttctggatccatatagccttctgggaccttctctgtattgactaacacggtatcaataaaagacttccctaaatgttgatgcaaaactcgaacatgatctgcatcagtaaagtgttctgtttcccctttttgcgtcatgatattgcagatgtaaacagtctccgctgccgtttctagcaacgcctgtccgatctcactgatcatcaaattcggcaagatactcgtaaacaagctacccggtcctaatacgatcatatcagcttctaatatcgacgtcacaactttacgtgcagctttgggttcattttcgtcatcttgattccgcacaaacacgtgatcgatggttttacgatccaaggcaattttggattctcccactgcttctgtcccgtctttaaaaacagcgtgcaaaatcaaaggttggtcagaagagggatagacatggccatcaatgtgcatgatttttgaaagtatctggatcgcttcataggtactgttgcgcatttccgcaatggcggcaatgatcaaattacctaaggcatggtttgcaagaaatttgtcttctttcttgaaccgatactgaaaaatatcattatagagttgcggcatatctgacaaagcagccagcacattgcgcaaatcacctggaggcgaaatagacgaaactaggttgcggatctcaccactgctgccaccatcatctgcgaccgtcacaattgctgtgatatcaacaccttgattccgcaaactttttaaaatgaccggcaggccagttccgcccccaatgacaacgatcttaggtttacggattcgataggttttcattttcatgatcgattcaccgtctctttgcgcttatctttgtcacgatgggtcacattgactttgtaattttttgctaaagcagcgctgatccgttcagataaagcgaccgaacgatgttgtccgcccgtacaaccaattgcgaccgtcaaactggtttttccttctttgatatacccaggcattatagtttcaagcaatgtctcaaattgctgataaaactcttcagtttctggaaaagacatgacatagtcatatacggtttcatcttttcccgttagcggacgcaattcgggtatataatgtgggtttggtaagaatcgcacgtccatcacgatatccgcatcgataggcaatccgtatttgaagccaaaggaaacaacttccacccgaaatccatgttcatgggaagaacgaaattcttgattgatcttttctcgcagctgtcttggtgttaaagttgtcgtgtcgatcacgatattcgcttttgtcttcaagtcttccaagatcgcacgctctttacggatcccttccgttattaagccgtccatcgcaaggggatgggctctgcgtgtctctttataacgagaaaccaactcattgtctgtagcatctaagaacaatatttttgtatcgatgaatcgagtattctcgatatcgatcagcatgctttggatttcttcaaaaaaggaacgcgaacgcaaatcaacgaccaatgcaattttggtcactttccctgactctttgatcaattcccagaatttaggaattaaactcggcggcatgttgtcaatacaaaaatagcccatgtcctcaaaactttgaatagcaacggtttttcctgctccactcataccagtgatgatcactagttctaaattatctacttctgtcatcgtaaaactccttcctcactcattaacagtatatcatgccgggcgtatcatttaaacactaccgcacaaaaaaagcatcaacatgagagttgactcccatgtcaatgcctcgctcaatttcgataagttaacgctttttcaattgttcgatcgactaaaatcgattgcgcatcgactaccggataaggattattttccgtgaattcttccatcaatgaaagttcggtacagcctaggacagctttctcacaaccaattttatgtgttacttcttctaagatctcaaaataaagatcttggtctaatgtatcagattctttgatccgatcataaatcaatgtatttactttttgttgtaattgcggctcaggcaagtagacatcaaagccacaagcacgtaactcggcttcataaatcccagccttgatactaccttctgttcctaaaaaggccactttcccggtaacaccttctttttgcaaagatttagcagcttcccgcggcatgtgaagtagcggaatcggtgtggcttcttgcaactgatcaaagaaataatgcgcagtattacatgtcagtacaataaaatttggctgtaataagttctgtttagcgatgtcatcaagcaaataaggaacaggatcttctaaatcgttgttcaagatatacgcagtgcgatctggcactgtcgcatgattgaataacacatagttcaaataatcttggtctttatgagcaacggttcgacggttcaagattcgtacaaaactttcagtcgccatcgttcccattccacctaagatactaaagaagttttccatagactagccttctttcgaatggaaatgcagtttaaatcgtttgttgtaaagatagaacattctttttagtagaatccaacgtttgatggagagatctttgtcataaaaaacggtagtcccccagcgattttcggctagcagctttttagcccgttctttttcttcattttcattggcataatccaaaaagatgtttttcggtacacccaaccaaagcttcgctgttggagcatatgctttcccataaacagtttcttggaaaggcacatcaaatactaagtcttctgtcagaaatttagcaagattcaatccacttaatgtgatgaaaaagctacttctcccctgacgaagattgatttcaaataatttgtattgcccatctcggctatcatatttcaaatcaaaattggcaaagccaacatattgaatttgttttaagaacgtcgaaatcatttgatagatttgttggttttcatccggcagaataaccacgtaattgccgactgctccaggagttggatcttctaaaagtggatgacccaatgccatcactcgtacattatggtctttgtcaacataggcattcagcacacgcatattgctgtcatcccctggaataaaatcttgcacgatcatctcgtaattatagccagcttgataaatccgctcaacaatcttatcgaactcggcacgatcttcgataataaaggctttcttccgtccttcgaaatcaacagataaccaggcgacactatttgccggtttcaatgccacgggaaactcaaatggcagttcttgagtaaagcggccatcctctaatagatctggtgtcaaaataaaagtttttggataaggtaagccaaactcttcacacacttcatagaaactcactttattgattaatcgtttcaacaaagaataatcattcgcaataaatgtgtaatatgacgctaaatctgctttatgtttcgctaacaattcagcataaccatccccgcaaggaatcaacaaataagccatagagggatcgttataagtggtttttgccaaatcaatcaatgtatctaaaaaaccaggatcatgatcaaatcctgctacttgattgaccttgacgattttgctatagcgggtgggggcaagctgtgtcccagcataagcaattgactggatgccatatgcttcgtgaaaggctcttgccataccatagacattcatatcgcttcctaacaaaataggaacgaatttttccggattcataaaaccactctctcttttgcatatataaatttagatttttacctatttactttgttacaacagacctataataccataaagaaaaaagcaatcaaagtatgtacctctgattgccttcctcttctttgaacggatagaacttataggtcgtttattctgttacgaatagacatttacctattgctattttaacaaataaacggtgcattacaagagttatttgagaatttgcagaattattacagtaaatattaaattttgctaaaatcccctttatctccgcctttatcctacctctctcataagactttcttgaggtattttccggtatagctttcaggaactgctgctatctcttcaggtgtaccagttgcaaggatcgttcctccgccctcgccgccttctggacctaaatcaatcacatgatctgctgatttgatcacatcaagattatgctcgatcactagaactgtattccctgcatcaacaaaacgctccaagactttcaataaacgagcaatatcatccgtatgcaaaccagttgtaggttcatctaatatatagaagctttttccgtgagaatttttgtggagttcactggcaagtttcattcgctgtgcttccccacctgataaagtggttgccggttgccccatcgtgacataccctaaacctacatcaacgatcgtttgtaattttcgatggatcttaggaatatgtttgaagaattcgacagcatcttcgaccgtcatctcaaggatctctgctatattcttccctttgtaatgcacttcgagggtttctgaattgtatcgtttgccgtggcaaacctcacaaggaacatagacatccggcaagaaatgcatctcgatcttgatgatcccatctcctttacatgcctcacagcgaccgccgcggacattaaagctgaagcgaccttttttataaccgcggactttggcttcattggtttttgcaaacaaatcacgaatgtcgtcaaaaacacttgtataagttgccggattacttcgaggggttcgcccgatgggactttggtcaatgtcgattagcttttcgattgcttcatatccggttagtttcttatattttcccggtttgttcgaattgcggttgattttttgtgctaaagcttttttcaaaatttcattcactaatgttgattttcccgaaccagataccccagtcacagcaataaactttccaagagggaaatcaacgctgacatttttcaagttgttctcagctgcgccagtcaagcgaatggactgtccatttcctgctcgacgttctgccggcgttggaatctcccgttttcctgaaagatattgtccagtcagtgaatgttcattagccgcaacttcctctggggtccctgctgcaacgatctcgccgccagcatgtccagctcccggacccacatcaattaaataatcagcagaacgcatggtgtcttcatcatgttcgaccacaatcaatgtattgccaagatctctcattttacgcaatgaatccaataagcggtcattgtctctctgatgaagaccgatcgaaggttcatccaagatataaagcacaccagaaagattggaaccaatttgtgtcgctaagcgaatacgttgagcttcgcccccggacaaagtgccagaagcccgacttaaagtcaaataatccaatcccacattgcgcaaaaagcttaaccggtcatccacttctttgacgatcggttttgcgatcatcttttctggttcagagagcgttaatttttcgacaaatgataaggcgttgttaattgccatctcactaagttcaccaatatgcttgccattcactttgacggataatgcttgtgggtttagccggtagccatgacaggttttacaggtcaattctgtcatgtacagacgcatttgttcccgggtgaaatcactattggtttcatgatagcgacgtttgatattaggaagaattccttcaaagggtacttcaacgtcccgtacaccgccaaaatcattttcataatgaaaatggaacatttcgccattggaaccattcaaaataattgcttggtgttcttctggcaattcttcaaaaggcgtgtccatgtcaatattgaattccaagcaagcttgttccagcatttgtggataatattgtgaactaatgggattccaaggaacgattgcaccttcacgcaacgttttgctagtatcaggaatcactagatcagtatcaacttctaattttacccctaatccatcacaatccggacaagccccaaaaggtgcattgaaagaaaacaaacgtggttctaactcgcctactgtgaagccgcaataaggacaagaatagtgttcactaaacaacatctcttcttgaccaatcacatctactacagcgtagccatctgccaaacgtaatgcggcttcaaaagaatcaaacaatcgcgaacgaatgccctctttgacaacgatccggtcaatcacgatggcgatgtcgtgttttttatttttttccagttcaggcgcttcagaaacatcatagatttcaccgtctactcgaatcctcacatacccttctcgttgaatcatttcaaaaacttttttgtgctggcctttcttttgataaacgatcggtgccaacaactggatctttgtccgatctggcaatgccagtacttcgtcgaccatttgttccactgattgactagtgatctcaatatgatcattcgggcagatcgggtgtccaatacgggcgtacagcaaacgcagatagtcattgatctcggtcaccgtaccgaccgttgagcgaggattcttactcgtcgttttctgatcaatggagatcgctggactcagtccatcgatactatccacatctggcttatccatttgtcctagaaattgtcgtgcatatgcagacaagctttccacataccgccgctgtccttctgcataaagggtatcaaacgccaaagagctctttcctgaaccagacaaaccggtcacaacaaccagtttatctctaggaatcgtcacatcaatgttctttaaattgtgtgcgcgagcgccatggattacgattttatcatttgccattctcttgtctccttttactcagctgctttcaattccaagatcgtgtctcgtaaagtagctgcagtttcaaagtctaatgcttttgcggcatctttcatttctttttccagttttaataagagagttgctttctcttcacgagtcatgtcttcatacgaagtggttgtataatcgcctgactcttccgcaactttcgtaatagcgatcaaatcgcgaatttccttaatgatcgtttttggttcgatgccatgctctttattatacgcctcttggatactgcggcggcgacttgtttcatcaatcgctcgctgcatagagtcagtcattttatccgcatacatgatcactttaccatcagaattccgagcagctcgaccaattgtttggaccaaagaacgctcactacgcaagaatccttctttatccgcatctaagatcgctacgagagaaacttcaggaacgtcgatcccttctcgaagcagattgatcccgactaatacatcaaattcaccaagccgcaaatcgcgaatgatctctgtccgctcaagtgtcttgacgtcactgtgaagatatttgactttgattcctaactctttaaaataatcggtcagatcctctgccatttttttcgtcaatgtggtaacaaagacccgttgatctttttctacccgctcattgatttctcctacaagatcatcaatttgccccatgatcgggcgaacctctactactggatccaataaccctgttggacgaatgatctgttggataacggtatccgtttgttcatgctcgtaaggtcccggcgttgctgagacataaacgatctgattcacatgttcttcaaattcttctaaacgtaacggccggttatctaacgcagacggtaaacgaaagccataatccaccagcatttgtttgcgggcacggtcgccgttgtacatcccacgaatctggggcatcgttacgtgagactcgtcaatcacgatcaggaaatcatcaggaaagaagtccagcaacgtgtaaggtggttcgccttctttgcgcccatccatgtgtcgtgaatagttttcgatcccggatgtgtagcccatttcccgcaacatttcgatatcataattggtgcgttgctctaaacgttgtgcttccaataatttgttctcacttcgaagaacagctaatcgatcttcgagttctttttgtatcgaagcgatagcatgttccatatggtcttcgttggtcacaaagtgagtagctgggaaaatagaaacgtgttctgtttcccctaaaatctccccagtcaacgcatccacttctcgaattcgatcgatctcatcgccaaaaaactcgatgcgtaatgcccgttcgtcccgcgatgccggaaaaatttctaccacatctcctcgaacacgaaagcgtccccgttggaaatcgatatcattgcgttcaaattgtatgtcgatcatttctttcagtagttgatcccgcggtttttccattcctactcgtaaagaaaccacttgcttagcatattcgattggtgaacccaaaccaaaaatacaagagactgaagcaaccacgatcacatcgttgcgttccagtaatgaactggtcgccgagtgccgcagcttgtcgatctcatcattgatacttgaatctttctcaatgtaagtatcactggaaggtacatatgcttctggttgataatagtcataatagctgacaaaatattctactgcattattaggaaagaattccttgaactcaccgtataattgacccgccaatgttttgttgtgtgcgataatcagtgttggcttattgacctctttgatcaagtttgaaacagtataggttttccctgttccagttgcccccaacaaaatctgcgccttcttgcccccaacgacgccatcgaccaattgatggatggcttctggctgatctcctgccggctgatattttgagagtaattcaaattcatgggaagtcgttctttcgatcatcttcattccccctgtatttatatttgcgaagcgtccgtgaaacaaaaagaaagctgacgcttttccatagaatagtataccatagcgaacatactttcgccatcttttgtactttttattctgctagtttaactttacttaagatgtcagtttttctaacacccaatgtcagaaatagcgctgttttttgcaaatattgaccgaaagacttgtgtgtttttacaaaaatacctataatctaaaaatacgttaaaatcaaaagggggaattttcttgaaaagaaaatatatgttttgtgcactgttttcagtgattttctgctttttcgcttttgcgaacaagccagtcagtgcagcagaaacaacgtataaaatcggaacagacctgacatttgctcctttcgaatttcaaaacgaaaaaaatgagtatgtagggatcgacattgatctgttaaatgctattgctgaagatcaaggctttgctgttgatttgcgcccattaggctttgattcctcgttacagggcgtccaatccaatcaacttgatgggatgatcgctgggatgagtattacagacgaacggaaagaaacctttgatttttcagatccttacttcgacagtgggattcagatggctgtcgcaaaagacaaccaagatatcaaaacttacgctgatttgaaagataaaacagttggcgctaaagttggtaccgagagtgctcgttttctagaaaccaatcaaaaaaaatatggctactctatcaaaaactatgatgatgctagcgggctttatggtgccgttcgcaatggaacagttgtggccatctttgatggctatccagtcttaggttatgcgattagtaatggtgaagctatgaaacttgtgggtgagcctgaaaaaggggcatcttacgggttcgcagtcaaaaaaggccaaaattctgaattactggctaaattcaacgctggtctaaaagagttgaaatccagtggtaaatacgacgaaatcattgctacttatattgcttcatcagaaagcacttctgatgaagcaagtgaaatggttaaagttgaaccgaaaaaagacgtctatcgaatctcaagtgactctgcattcgcacctttcgagtttcaaaatgaagacaatgaatatgtcggaatcgatgttgatctcttaactagagcggcggaaatgcaaggattcaacattgagtttaatttcattggtttctcaggagcgctacaagcgttagatgggaatcaagcggatggtatgattgctgggatgagtatcaatgatgaacgcaaaaaagcgtatgacttctcagactcctactttgaaagtggtattcaaattgcggtcaaagaaggaaacgatagtatcaagtcttatgaagatttagaaggaaaaacagttggtgctaaagttggtaccgagagtgcagacttcttgattgaaaatgaagacaaatacggctataccattaagtattatgacgcagctgatcaactttatgctgcagtcagtggcggtcagatcgacgccatgatggatgattacccagtcattggctacgccatcagtcaaggacaaaaactaagtacgccgattgagaaagaagtgggcggacaatatgggtttgccgtcaaaaaaggccaaaatcctgaattgatccaaatgttcaatgaagcgttaaaagaaatgaaacgaactggcgaatacgatgaaatcgtcggccgttatatcaaagacggttcggctacagaaaagaaagccgatgaatcaacagtcgctggtttaatcaaaaacaattacaaagttttgctaaaaggtttatggaataccctgctgcttgcattgatctcctttgctttagcgttgatcattgggatcatcttgggactcttcagcgtgtccccaatccgagctttgcgtatcttcgccggtatctatgtcgatattattcgcgggataccaatgatggtgttagctttcttcattttctttggcctttcggatgcaattgggattacaatccccgactttgctgcaggagtcatcactttgacactgaacgctagtgcgtatatcgcagagatcgttcgcggagggatcaaagctgttcctgtaggccaaatggaagcttcccgcagtttgggattgacctatacccgaaccatgcaaaaaatcattttgccgcaagccatcaagatcatgatcccatctttcgtcaatcaattcgttatctcgctgaaagatacgacaatcatttcggttattggtgttgtggagctgctgcaaactggtaagatcattgtcgcaagaaccacacaaagtacctatgtttatctaatcgttgctgtcatgtatctaattgttatcacagccttaacaaaacttgctaaagttttagaaaagaaggtgaaataaatgaaggaaaaaatcttagtcgaaaatcttgtaaaaaaatatggggataacactgttttaaatgatatcaatgtctcgatccaagaaggcgaagtcgtttgtgttatcggtccttctggctcaggaaaatctactttcctgcgttgcttgaaccgtttagaagaacctactagtggtgatatcattatcgatggtgctcatctaatggataaaaacaccaatatcaatgccgtccgtcaacacataggcatggtttttcaacatttcaatctgtttcctcatctctctgtactagagaatattatcttagcaccgatggatttaaaaaagatgtctcgtaatgaagctgaatcaaaagccattcaattgctggacacagtgggtttggctgacaaaaaagacatgtatccagacaatctatctggtggtcaaaaacaacgggtagccatcgcccgtgcattagctatgaatcctgatgttatgctgtttgatgaacctacatctgcgttggaccctgaaatggtcggtgatgttttgaatgttatgaaaaaattggcaaaacaaggcatgacgatggttatcgttacccatgagatgggttttgctaaagaagtagccaatcgcgtcatgtttatcgatggcggaaatttcctagaagacggcacaccagaacaaattttcactagtccgaaaaacgaacggaccaaagactttttagacaaagtcttgaatatctaaacaaaatccgcagaaaacttggtcgttttctgcggattttgttattcatctgacattttagtttctcgttgctgctttttgtactgtgcttctaaagcgattcgtttctgcttttcaccaaaataaacttttgtatcgattggattggctttgttgaatcccccagcaccagtatccatcatttgcccccagcctttcagcggatcttttccttgtttccttaattcagcgttctttttacgcaattcttgtttcttcgcttctttcttttgctgccgctgctcctttatttccttaaaaaaactcatcccataccctcctttgatcaataaagaattgttccaatgactattaataacaaaacaacaactggatacatcaattctctgatccagtgtttttctttccaagcaagatacagcaaaccgccaatgatcagcaataaaatagtcggttcaaacaataagccaatcaaattacttgaataggttctggttgttagttgatcactccctgtgcttaacctaaaagaactgaaacgaaaaagaatgaaacgactgaaaacataacaagacaaaaacaccaatgaatacccttttgcaaaccaacggaatagtttgctaaatggaatttttttcaacaatactcattctccttccgtgattacatcttggaccatgatatctgagagctgctgcagctggactctcatgacaagcgaccgattctccgctaaccatcgagctaattcagtgcaagaggccgatacatgaacggcacttactttcacaccattatctttgacataatttagaatgtcgccgaaatcatagaaattgatttgattggtaagatcattggtaaaatggagattgtcaggactatcccagcctagatccccaaaagtcggataatatttttccaaaaaaaccagtccttgcgtgacgctttctgttacttgccgatcataatcatttcctgttgtctgacgaaccatttcatctgaataaccaaaaatattgtctgaatgataatcaatactataatgttgaacagacaaatcagccagtttttcccttagctcactaggaatttgaggattttttaaagtaatagaaatttcagcctgcttgtactcgccgagtgaacgtaaataggcgagaaaggagtcataggtcgaaaccgcattgcctggctcatatagtgttgcagagggagcaaatgcggtcagcgtatcgctggaaacaattgtctgaactgcctgatcaaaaatatagcgattttcgactgtgtacgcgaccgtcttctgatttcctaaacgagaaatgaccggataaacgtcctctttccccaaaaatgcaagcagagattgccgattgataggatcgtaatggaggtttcgctgtcccatctcataccaatagtagcggtacttctctaacgtatcattcttaagcgcatcttccgaatatagagcattcatcgccgaaggaatcgattgataatcctcgcggtcatttccggttgcacgataataggctaatggtaaaaagtagcataaaacaagcactaccatcccccaaaacaacacgctatagatcatttggagtaccatgcttttctttgtacgatccactgacttttgtaatcgctggtactgttttttatccatgtgaccacctgcttttcacttgttttctcgcttgaaaaacacgagatttcactgtacttaacgttagatttaatatttctgctatttcttgatagctatagccgcgaatcgccaatatcaaaggatgccttaatttgttaggcaattgattcacatgacggagcgcttcttctttttcaagactatcttggtcttcgataggaatctcctgcatcaaagtatcgacttcttccgctaccaaaagataccgcttacgacggtaaaaatcatatagtgtaaacttagcaatcgtaaagagccacctctcaaagtcatctggctttgtctttggcaaagccaaaaaaactttaacaaatacatcttgcgttaaatcctctgcttgatactcatcccccactcttttttgaaagtagtgctgaattttctcgtaatagatctgataaatctcctccaacactacccctccttacttatatagacgagtgaacaacaaaaaagttgcaaaaaaatattatagtaagaatagtatatcactgttactaacgtattcagaaggttctttctacgtaacaaaacaaaaaaagctgtaaaccacgctgaaatgtttcgtgtggcttacagctttttagaatggatttaagcaaagacggttgaccagttctcccgttcggctaaaaactcccttgccaattgttgggcgccttctaaggtatggttggctgcccagccgcattggacttcgttactagctggaacttctgtcgctttcaacacatcttccatcgttttttctaacacagttaaaatttcatcataatcttcatgatttaaaaccgttagataaaatcctgtttgacagcccatcggagaccagtcaacaatgtaatcggcatgattacgaatcaattctgcggtcaagtgctctaatgagtggaggctagccatctccatatgtgcttgattcggttgtttcaatcgaacatcatatttgataatcgtatcttttgttccttgttttttgtcagcgacccgtacataaggtgccttgactttcgtatgatctagattaaagctttccacgttcattttcattctttttctcctctcgcttcgacgagccaaacaaaagcattgatttgtttaaagcgactggtaaaaccattggctcgaaaataggtttcaatatctggtatcaatgggtagtattctcgttgcagatccgctgctaatcgtaagtgattggctttgattgcctgtcttaggatgctttctttatgctcaggggataaaaacatcgtatcccctataatgacttttccgccttcagaaagcagcgctttatatcttttaatcactcgctgtttctctgtttcattcaagtgatgaaagacataactagaaacgatcgtatcgattggaaaattgatctgtggaaattgttccatatctccatcaataaaagttacctgtgacaactccggctttgcctcagctacttgacgcatcgcagccgatggctcgatcgcgaacactgttttctttcttcgaatcaactccaacgtcaaatttcccgtaccactaccaaattctatcacagaatctcctgctttttcagcaatatttgctaacaattctggataatgaagaaaaacctcccgatattcttcatccttccctttgacggtctcgtcatattgcttggcccactcagaaaaaatcggaatgaattcacgccccatcttccagcaccctttctaatccttgctttaagtccgtccataaatcggcagcgtcttcaatgccaatagacaaacggatcaagccatctttgattcccgctttttctctgattgaaggtggaattgaagcatgcgtcatgaccgcaggaacttcaactaaactttcaacgccacctaagctttcagctagtgtaaaaatagttagcgattcaacaaacgcagctactcggttttcggcttttaattcaaatgaaatcatcccgctaaaaccagacatttgttttttggcgatctcatgtcctttatggcttgataaccccggataataaactctagctacagctgcatgttcttgaagcaatgtggcgatttttagtgcattggcttgatgggcttccatcctcaaagccaatgttttgatgctccgctgaactagccagctgtcatgaggccctaacacaccacctatagcattttgcagaaaaccaatttgctcagctagttccgcttgattggttacgactaacccagcaacgacatcactatggccccccagatatttcgttgcactatgaatgacaatatcggcacctaatgccagtggacgctgaaaataaggtgtcgcaaatgtgttatcaacgatggtcaagagatcctttttcttagcaatcgtggcaacttgttgaatatctgtgattttcaacaaaggattagtaggcgtctccagaaagattcctcttgtttctggccgaatcgctgcggcaatccgctgaatcgcttggggatcatcagtcttgaccaatgtatacgtcaatccattctttttgaagattttctgaagcagtcgaaaggtgcctccatagacatcatctcccaacaaaatatggtctccggactgaaataaagaaaaaatagtatgggttgctgctaaacctgaagcaaaagcaaacccacgtatgccttcttccagttcagcaatcagttcttctaatgcaaaccgtgtaggattgcccgaacgagagtactcatattgttttggctgtcccacagctacttgcttgtaggtagacgtttgatagataggtacactgacagcccccgtttcttgatcttgactgatcccagcatgaatcaattttgtgcgaaattccatgtttatgcctcctctagttgaccataaatattttttgacaagtagcgatctccactgtcaggaaagatagtgacgatcgtgcttccctttggcagtcgcttgctttctcggatagcggctgcaaatgctgcaccgctggaactgcctaccaatagaccatgacgggctgccagcaaccgggtataataaaatccctctggatcactgatagtctcaatgctgtctggcataagactcttaaaaaagatcggcctctcttcaacgcctatcccctcgatcgcatgttcatgagcaggcccgccattcaagatcgatccctctggttccacagcaatcaaacgtatagtagaatctatcgactttaaatacgcacctgtcccggcgaaagtcccgccactccccactcctgctacaaaactgtcaattctctcaggaatttcttgaacgatttccggacctagtgttcgataataggcagccggattttgttcattttcaaactgtagcggcaaaaaagagtttggcaattgatcagcaagaaatttggctttcctgattgccccttgcatgccttcttgactaggcgagtgaatgattcgtgctcctaaggctttgattagttgttgcttttcttgactgaatgtatctggaatcacaaaaagcatgtctaatccatatgccaaaccggctaaagctaagccaatcccagtattgccagcggtgggttcaatcacggttgtgtctttcgttattcttccagcagcaactgcttctgagatcaaataactgcctaatcggtctttgatactacctccagggtttaagtattctaatttcgcatagatccggctttggctttctccgccgtagtcagtggctaaaaactgaaaaatcggtgtcttaccaattaattctttaatatctgatacgatcatgggcaaccttcttttcaatgaaatttttgttgtcagtccgctaaagtgctgcagcaaatcagaggcactgcgttttacaattggtcattcctaggtgatcacctgcttaaaaaggcatgatctgtctttgtttacagatctttgcaaggtaaatcaaagcaaacaaaaagaggcactgactattcaatcagtacctcttagagaatgactctaggactctttcccaacgaaagagactcttagagtgatttatccagatgagggaacgattaataggcatgacaaatcagtatgctgctttttagcaccatacaacaacaacataccaatgcaaagttgttgtttgtcatgtctacgtcccctcctttttaagcttgtaaacaaaatagcatgggaaaaaatagaagtcaatctttttttctttgtgaaaaatttttggtgacatatgcatcgacagcctgaaatgcatttgctacctcttctgctgtgatcttaaagggcattcgatggatcgtttcattagggagagtggcttgaataccgattgctagtaattcctgatcgttaagtgagtccatctgcatttctgctaacgttgttggtaaccccagagcttgatataaaacaatataacgttccaactcgtttgtatcttgttccaacagcaattgcatcaacgtcgtataggcaattttttctccgtgagaaagttggtggaacttcccagtagcggctgtcaacccattatggatcgcatgagctgctgctagtcctccactttcaaatcctagtccgctcaaaagtgtattcgcctccactacttgatcgaaagcggctgttacctgttgctgctgattggccttataggcagcgaccccattggcaaacagcactgcttcacatttctcagcaattgccatagctgctaaagtcggccgtcctcctacaagattctgagcgccgcttttagctactgctctggcttcaacatacgtcgccaatccatcggcgatgccgaaagttaataattttgcaggggccttggctaacagagttgtatcaaccaagaccagttctggattcttcggataataactatactgttcaaatttcccttctttcgaataaagaaccgagatggaggaggtaggggcatctgttgaggcaactgttggtacgacagcaaccgctcgcttcaaatgatgggccactgctttaccggtatcgatcacctttccgccaccaagagcaacaactgctgccgcttctgctctttctgcttcttttgcaatacgtctgatttctgcattggaggattcaccgctgaaatttgctaaggttacttcgattcctagatgggctaaatcgcttgccagttcttcgccagcaatcctccaaacaaatggatcggttattagtaataatttatctcctaatgagctaatatagtgcaagccttttttaatacgttttctccttgaatgtagcgctgcagactaacaaatattttttccatgaactctcctactttcatttttttataccaattcccgacattgttaaaattttcacaaacgctagtaaaagcgcagcctgaaaaagtggttttcttcaggctccgctttttattttttcttaccaccaaaggcatctttcattttatcaaaaaatccttcaggttgttgctcattggttacatggccgcttgcttttgcataagcccgtaacgcttctttttgttcttcattcaaattctttggtgtgatcaacttaactttgacttgttggtcaccattgccattgccacgtaattttggtgcacctttgcctcttagacggaaattcgtgcccgtctgggtaccagcaggaatcttcaatttgacatttccgtgaacagtcggaacattgacctcgtcacctaaagctgcttgaacaaagttcaatggtaattcgtaataaatttcggatccatcacgatcgaagatatcactttcctcaacacggaaaacgacatacaggtctccataaggtccgccattgctgccagcttctccttgaccggataggcgcatttgttgaccatcttccacgccagcgggtacattgactttgacgctatgttttttcttttcgtgtcctgtgccatgacaagtcatacaaggttctttgatttctttccctgtaccgtgacatacatcacaggtttgacggctcatgacacgaccaagaggtgtttgacgttccacattgatcgtacctgagccatgacatttatgacaggtttcaggttgtgttcctggttttgcgccattaccgccacaagtatgacaggtttcttcgcggttatactgaatatttttttccacaccaaaaatcgcttcttcgaaagaaagatccacagcatattgcaaatcagctccttgtcgcggagcatttggatttgccgttctgccaccgccgccaaagaatgattcaaagatgtcttcaaatccaccaaagccgccaccggagaatcccccgccgttaaagccgccaaagccgccgccataaccaccaccgtagttcggatcagttcccgcgtgaccatattgatcgtaagcagctcgtttttgaggatcgctcagtatttcatatgcttcagaaatttctttgaattttgcttctgcatcaggttctttattgatgtctggatgatactttttggaaagcttccgatatgctttttttatttcgtcatccgaagcccctttttgtagacctaagacctcataataatctcttttgtctgccattggcttccctccactattttcttgcgtccctcgtattttagcatataatttgcttcagaaaaatacgtttcagaaattcataagaaaaagccaaagtggtgactttggctttttcacaaacagcgattatttatcgtcgccgtctacttcttcaaaatcggcgtctaccacatcgtctgcgccgccttgtgcagcttctggattttcttgtgcttgttgttgtgcagcttgctcatacaacttcactgtcaagttttgtacgatttcattcaatgcatcgcgttttgttttcatttcttcgatattgtttgcatcgacagcagctttcaactcatcacgagcttcttccgctttcttcacttcatcggcatctaccttgccttcaagctctttcaatgttttgtcaacagtgaatagtaatgcgtcgacatcattacgcaaatcaacttcttctttacgttgtttgtctgcttccgcatttgcttccgcatctttaaccatccgttcaatttcttcatcggttagacctgaagaagatttgatcgtgattttttgttctttttgagttcctaaatcttttgcagatacatttacgataccatttttatcaatatcaaatgttacttcgatttgtggaattcctcgaggtgctggtggaatttccgttaattggaatcttcctaatgtcttgttgtcagcagccattggacgttcgccttgtaggacatggatgtctacagcaggttgattgtctgcagctgttgagaagacttgtgacttgcttgttgggatcgtcgtattgcgatcaatcaacttcgtaaagacgccgcccattgtttcgatacccaatgataatggtgtgacatcaagtaaaacgacatctttcacatcaccagtgatcacgccaccttgaatcgcagcacccattgctactacttcatctgggttcactgatttgtttggttctttattggtttctttgcgaactgcttcgacgactgcaggaatccgagttgatccaccgactaagatcacttcatcgatttcagattgtgaaagaccagcatcttttagcgcttgacgtacaggaacttttgtccgttcgactaaatcagcggttaattcatcaaattttgcccgtgtcaatgtcatttctaagtgcaatggaccagcatcgccagctgtaataaatggcaagctgatttgtgtacttgtcacacctgaaaggtcttttttcgctttttcagcagcatctttcagacgttgcaatgccattttgtctttacctaaatcaatgccattttcttttttgaattctgcaaccatgtgatcgataatcttgttatcaaagtcatctccacctagattgttgtccccagcagtagacaacacatcgaatacgccatcccctaattcaaggatcgatacgtcaaatgtacccccaccaaggtcgaagactaggattttttcgtctttgtctgttttgtctaatccataagctaaagctgctgctgttggttcgttgacgattcgttctacttctaatccggcaattttaccagcatcttttgttgcttgacgttgtgcatcattgaagtaagcaggaacagtgataactgctttgtctactttttctcctagataatcttcagcaaatcctttgatatattgtaggaccattgcagagatttcttgaggagtgtatgatttcccttcaacttctactttatagccagcttcacccatatgacgtttgattgatgaaatcgtgttagggttcgtaactgcttgacgtttagcaacttcccctacttggatctcgccgtttttaaatgaaacaacagatggtgttgtacgatttccttctggattggtgatgatttttgcttcgccgccttctaggacagcaacagctgaattagttgtacctaagtcaataccgataattttactcataagtaatacgctccttttcattcatcgttctttttatttattgtgctacgataaccatacttgcacgcaagacacgatcatgcagcttatagcccttttgcaatactgtgacgatcgtatccgcaggcacatcttctgtcgcaggtacggtctgtaccgcttgatgaagattgggatcgaaagtttctccttcagcaggaatttcttcgattccttcttctttcaacgcttgacgcaaactttccaacaccatttcgacaccttttttcaagttagccgcttggtcttcttccacatttgctgccatagcgcgttccaaattatcgatcgctggcaataattttttgcccaaatcttgcgaacggtatttttgcaacaattcacgttcattacggtttcttgctgtaatattagcgatttcggcccgtgcgcgcagaaattggtcttctagttcattgtttttttcttttaaactgtcgatctcgcttttttctacttctgcttctgatagaccagctgcatcgatttcttcttctgacggttctgtcagaggctcttcagttgtctcaagatctttttctacctgttcttctttttctgacacttgctaccatcccttctataattcacttatttgatcattcactgtttgcatctagtgtgcgatagtaatcagccaatgtcattgctaattctcgacgaaaggcatccatcagtccaaacattcgcgaataaggcatactagaaggacctaataaagcaatcgtcccttggccatgaccttcaatgtcatagcttgcttgaatcaaactcatattttggagtaattcattccctagttcctgaccaatgcggatctgaatcgtggagtctctcggtgccaataattgtgtgagttcttctgcatttttcatgaaagagtacatcgacttaaactgacgaacatcttgacttggttcaaaatctaatagattcatccgtccgccgacgtaaattttctcttcaaagagatgactcaacatatcatcgaataaatcaatgattccttctgttgtttgaaaatacttgtgcaaaatcatcggaatctctgttcgcaatcgatgatagaccgtcatgagcggttcacccactaatttttcattgataatccgaaccatcttttctaaatcgctgctatccatcgatgaaggtaatgaaaaaatctgattttcaacattgcctttatccgtaacaatgatagcaataatttgtcgtgcattcaaaggtacgatccgaaagccagtcaatttccgttctttgacatccggtcctaacgataatgcggtatagctcgtaagattggataggatcgtagcagattgctgaatgatttcattgatttcatgaaattctttccccaaggaatggcgaattgctttgatctcattttgattgacttttgatggtcttaataagtgatcaacgtaatagcggtagccggccattgaaggaacacgtccagaagaggaatgtgtcttcaataagagacccgcttcttctaaggccttcatctcattgcggatggtagccgaacttgcttcaaccccatcctccatcaatcgtttggagcccgtaggctgaccagtatccgtataattttggatgatgaggtgtaaaatagtttgttgtcgttgtgtcaacatcttatccactcctccgttagcactctttcacattaagtgctaacacgattattaatataccatatttcctacgaatgtcaagaatttgacacagatttttagcactcttatagagagagtgctaatccacttcattgtcaattagctccaaaaaaagaagatcgaaaacagctcgatcttcttggttattcttaacttaataaaaatttttcaaatacatcattgccgataaacatcccagactttgttaaataaacgcggtctccttctgagactaaccagccatttttagaaagttcttcaacgacattgccatagatcgaatcaaaagaacaggcaaatttatttgaaaaggctgttttcgatacaccttgtttcttccgtaatccaagaaacatttcttcttccatttgattgctggtcgttaacgattctgtttcatggatcggcagttgatcttccctcaatggacgcagatagtgctggatcggtccaaagtttttgtatctcgtctgtccgatataaccactcgctcctgcgccaaatccgtaataatgttcattattccaataaacaagattgtgcttagactcatatcctggccgggaaaaattactgatctcatattgcgataagccagctttagccattgcagtgatggcttcttcaaacatttgtgtctcagattcctgagaaggcaactccattttcccttgcctaacccaattcatgaacatcgttttgttctctaaaatcagtgaatacatagcatagtgaggcaaacccaaatcaatcgctcgtgttagcgtatctcgaaaactttccatcgtttgtccaggtaaagcataaatcagatcgatcgtaatattttgaaaatcatgtttatctaacaaccgaatcgtttgatagacatcctctgccgtgtgcttgcggccgattttctttaacaagcggttatcaaaagtctgcacccccatcgacaaccgatcaatgcccagatttttcaaaactagcaatttatcttccgttaaatccccaggattggcctctaccgtaaattctttggtcgtttgcgtgggcagtaattcatgtatgcctgtaatcagaaggtctagctgcgcagccgaaagggaagtcggcgttccgccgccaatataaatcgtctcacaagtagtgattggttgtttgctcaccgttagagcgatttctttcagcaaacactcgatgtattcatcaaccggttgcccttctaaaaaaactttattaaagtcacagtaataacaaatatgttcacagaatgggatgtgaatataggcagaagtactggtgggaagtgtattgattggaatcttattcatggtttgcatatttttattcctttcagagatcaaatcaacgttcaactgcacaaatacggctcgcagcaaatgaacctgatccgaggtatatccgctccccattctatcataagtaagattatctcgaaacgcctctgcattaaaagtagttagaagcagatctcactgctatccgttaataagaatacaatcgcatgcgcaaaattttaaaatcttcaccgataaatgggaaataggcttcatccccattcaggcgacgatttgtccgccattgcccatcttgtagacccccctcttctaaagaaaggatacctaaaggattagaaccctgctgcgcttgcagatccaatgcgaaattagcaccggtgagatagtaatattctttgtgtttaatgatcagacctgcggaattgatcattttgtctcgagaaaataatttgactgcccagcgatcctgaccattttcatacacaatttggttctgagccccttcttttttaaatgagaagatttgagcttcctgatcttgcaacagtggctcaagggcggcgatgattcgatacccttggtttaaatgaggcagtgtatcggaagaatcaaaggcgtctttcgctaatcctaactgggataaaaagcggtaatcctgactagtatcatccgttagaagatcttcgataccaaaaggtgaatagccgattgctccttgaccaaaagcataaaatagattcgaaatatatcttttgtcaattcgggtttccggaattaacaacggctgatcattcccgtattccgcgatgatcggtttgatttcttcttcgtaaatatctggggcaataaaatccaactgagaggcaataactttccaaacttgccaagtggtggatacagcgccaccactaggatattctcccggccgcctgtctggctttttgagccatacattcgtaaataacggcaacgctaaacgttttcttgcaatctttgcatagtcttggattgctgcggcataatgatatgccataaacacttcatccccaaagggtacttctgaccattgtttagctccgggatagaggtttctgatttcttgcggcaacgccatctgatagactttttctgctgctgacgaatgatcacgactagtgccaagactaccaatctcgttttcaatctgcaccattctgataaaggcccgcaaaggatggcttcccaagtagtcgcagatggcggcaaaggctgaatgagcctgtgctatcacatcttgacatagcggactataactattcatcttgtttccgtcgctatcctctatgcgaaaatatttaggatccgttttgatccattcaggaacatacgtggataagccattcttccaaaggccaaaccacaaaaaaatcacatcgattttcttctcagcggcattttccaaatgggaatcaattaatgaaaaatcaaactgattaggctgtggttcgatcagctcccaataaataggtatcaaaagggtattgatcgcaactttgtcaatcttgtcccatactttttcctccatgtaagcgatagaggaagcagtggagttatggacttctcctcctagtatcaatttttgagaatgctgtcgttgtttcatcattgtcctcctttttcttctcagacagatagtcacgttttgatcgactatccctctcaggtagttgcaagcgtttttagtcgtaattctattataggaatcttctaaaataaggtatactaaaaaaagagaattcatactaaaaaaacagaaatgaggtttttgatgaatcgagcagcactagaatcaattgtgaaaaaactctacgataaatatttgattcctttatttatcttcgatgaaaaacagcaagtggtgattcctcgtaattccttcataactgataaacaagtggcggaacattttttccttaccagccaatcgactgaattggatgtggtgacgttttttgaaggagatgacttttttttcagcagctttacttgtgatctaccagattcttcaattggcaatgtgctgattggaccttgcgggatattaggtactaacaaaagatcatttccttttcaaggatatgattacattgctggggtccattactcgaaagaaagtcgagaatcttttgtcgctttcgttgaattgttttacacgatcctaaaaggagccatccctgatgccaacaagtttcgttggagcgttccagagaaacaagcaaattccaatacgtccaccctattagaagaaaatctttatcaacgacggttagaggatccttatttggactcgtttgaatttgagaaacgttacgtagaggctgtacgccgaaatcaacccgaaaaaattctttggctattccataaaatgagcagcacctacagcgtcgaactagcaaacaacaagctagaaagtttgaaatacaagtattcaggattgattaccattctaactcgggtcagtatcaatgaaggcgttccggtgagtcaagcctatgggttatccgatacactactccaaaaactacaaaatatttatgacgttcaggaatgtttgacccatattcaggaaagtacttatcatttcatgaggttgattcatgcatttcctacccagaaaagttttttgatcagaagtctcatcaattacattgatacgcatatttacgataaaattacattaaacgatttggctgaatttactgaaaaacaccccacccatctgagcacagaattcaaaaaacatgtaggccaaacgatccacacctatatcaatcagcagaaagtagcggaagcaaagcatttgttagtgtttactgattatagctataaagaaatagctgcattgcttcatttttcgaatcaaagccactttatccaagtattcaagcaatttgcgatcatttctcctaaagaatatcgcaaaaactatttctcaagtgtcttttgttcaactgatagttgatggatcaacttataaattctctctaaacaaggttgttaaccgtctttttctgccctccataaaaaaaggagtggatttctccactccttaaaagactcatgttttgggttaactactgctcacagtaattttttgctaacaacgacttatttaactaggtctgaccttcgcatgctatagtgagaaaaaaagctcttcaggctatacgttttcctatcattgaataaacatccgcaagagcgaaatcagataacgaatcaatcgatagatcaaaaacaagaaaaacaggttacctaaaataaagcggaagccatttccaatggaggcacgaaacgagcggaaactaaagtaacgggaccatttgctaaaagtagtttgtccatttcttctaatgcgataggcttcatcataagtattctccaacatatcatagtaaaagataaaaagaggttgtttagggaaaaatgcttttttgaatcctgccatcaacgtgtacgttttattagcagacggaaaattccgattgccgtttttcttgattcgcacttgctgcccgtttttatttttggcagcataataatcttcaaattctacgatttgataaatgatcggttcgctattttcttgttcaaattcagcaattatttgatcgacttcttgccaacgtagataaagccaagcaaacaacacgagcaaaacagcaatcaaaaacaaatttagtagaaatccctcttggatcagcgctagataagcacaaataatcaaaagagcgattccaacaacaatcattcttcgttggaaataactgcgatacatttgttcaaaagatcgccgataataggcaaagtcatcttttacaaaattcatgatcgtcccactttctgaaaagattatttggttcaatttatcaatatcttgtgaaaatgtcaatttatctctcgagtgatcttttttttatttaaatagaatcatttctcttgacttcttataggctactcgggttaaagtaatagataggaaaacgcttttaaaaaaatagaaagttgggaaactatgagtctactgaatgaaacattcacactgaagaatcaaatcaaaatacctaagatcggattgggcacttggcagtcctctccggaagatgcctatcatgcgacaaaatttgctcttgaaaacggctatcgtcatgtggatactgctgctgcctataaaaacgaagcggctgtgggcaaagccctccgagattctggtgttcctcgagaagagatattcgttacgacaaaaattcctgctgaactgaagtcatttcaagaagctgtcgatagcatcaaacgctcaatggcagagcttgacactgagtatatcgatcttgttttgatccatgctccacgaccttggaaaatcatgcgggataatccggagcaaaaaaaatatttcgaagaaaacattgatgtctggaaagcactggaagaagcgtatcaaagtggtttgatcaaatcgattggtgtttccaattttgaccaagatgacctgcaaaatatttttgaccattgcgatgtgaaaccaatggtcaatcaaatcatttatcatattggaaaaacaaatgaagagttgctgcaattctgtaaagacaacgaccttttagtggaaggttattcaccaatcgcgactggtcgcttgctggataatgccgacatcaagaaaattgccgagaactatcaacgctcgatccctcaattatctattcgttatctattgcaaaaggacattttaccattgccaaaatccgttcacgaagaatatattttggataatgcaaaagttgattttaccatttccgatgaagatatggcctttttagatcaactctaaacgtccctaacgcaaaaaatcgctcacctgcaaaatgatcaacttgcaggtgagcctttttacggttgttttatactaattgttcaaaggttccccagactttcacgttttttttatcgaccatcgcttttcctttagcgatcaccgtttcaacatctagcgtatcttgattcaacaggcaaagatcggcatccattccaggagcgatccggcctttttgagccaacttcaaaatctttgctggattagaagtaattgcacgcaatgcaatctccaaaggaatctgttctacttgtacagcttctttgattcctaccaataaagctcgggaactgcctaccccaagcccaatgaattgattgttttcatcaaagtaaggcagacttccttgaccatccgatgtcatggtgaattgatccaacccgataccttcgtctaacaaacgttttagccctttactaaagcgaacttcatcatcttctctttcccaaaaatcaggatcttcacttgcggtaaaatcgatggtaccgcccattttagcaaaagcgatacttgcttcaaacaactcacttgtccgatttgcatgagtcggtaaaaattgactaatagggatctcagtctcctccacagtttgtagcaagagttcgtattgtcgcttgccaccacctaaatgcacattggtgatccctgcttttcctgagagcatgccccctactcgagcatctgctacagcacgagtaaattcttcaaaactaggttgtgaagaacggtgatctgagaccgcaatttcaccaatgccaatcactttgtcgatcgtcaaaaagtccttgatcaatgaatccgtcactggatcaagaggcaatcgatacgaaccgtcatagacataagtcgagattccttccgcttctaaacctttggctttgctgatcaatgccaccatatcacgcccaacaccatcggttcctaaacagccgacaaccgttgtgactccagcagttgtcagctggctaagggttacttcaggcgttcggttctggtagcccccttccccgccaccacctaagatatggaaatggcaatcgatgaatcctggtgtcgcaatcaatgaagaaccatcgatttcttcgacagttagttgatcaaagccgccactgatttgatcttcgatggcaacaattttgtcattgatcactaaaatatctttctttcctaaatattctggtgcataaacttccgcttgacgaataagtttcattctcgcagctcctctcttattgcagaccaatcgctacagcgataaagataaagatcgtacctaacacaaacagaaatccttgcattttaatttggaacttcgcccattttgcccattcgattcgggcaacgccaagcacaccgatcaaactggcagatactggagtgaatgcatccatgaatccggaacctaattgataagctaaaacggcgatctgtctggagacacccacaagatcagctaatggcgccatgatcggcattgtcaatgctgcttgacctgagttcgaagtaacaactaaattaaataagctttggaaaatatacatgaaccaagcaccgataaaggctggcacaccgcttagcaatccgccgatgctgtgtaggatcgtattcaacgctgaaggcacattggcatcagaaccacctagaacaagcaggattccttttgccatcccaacaacaatcgctgttccggccaaatcagctgcacctgattgaaaagcacttgctacatcattcaagcccatgtcttctaacttaaagatcacagcaatcaggcctgcacctaagcccatcacgaagaactgtgaagcaatttctggaatatagtaccctttttgtgttactccccagacgatccaaatcaaaactgccagcatttcaagcaaaatcagtttatgccccaaaagaaacggcttgttttcatcagatgtcttctggatatggtcgcggaaataggcatccgatttgtaagtcaatgatttctccggattcttacgaatacgttctgcatacaccatcaaatatgcagctgataagccagtaatgactacccacatgataattcggaaagttgcccctgaaagaactgggatacccgcgatcccttgcgcaaccgccacactaaacggactcatccaagaagttgcatttccgatttgcgaggccacataggtgaccgttaccgccacgatcgaatcatacccaagtgcgatcacaaatggcaccatgaccatagaaaaaggaattacttcttccgccatcccaaaagttgctcctccaaatgaaaaagcaaagaataaaagcggtaaagccaatcgttctaatcctcgtgtcttactgataaaggcaaaaatcccagcatcaatcgctccggtcttcataatgatcccaaatgcgccaccgactactaagatcaacgcagcgatcccgacagcggaaccatatttatctcctgaaaccaatccttcaaacacaaagttcaagaaaccaaaaccgccaaaatcatctgttccccaaacctttgctgtcttatgaagtttttctgatgtatcatagattttatctccatataactcataaagaacatcatccgttagggagagctcatcgagcttttcttgatcaagtttcgactccccttcgtctagcacactttgcagtgctgcttgatcgacacccaattcttctagctctgctggattttcttctaaattctctaactgctcgaagacaaaatcggtattaagcggatacgcataacggaatgaatcttgtttcaaaaccgttcgcgtgctcacttcaccatttgcatcaacatattcaatctcttccgtactgaattttccggcaggaatcagaaatgtcaatacccatgctaccagcactacgccaaaaatgatcacatacgtgtgtggcgttttcatttttgttaaatcttttttctttttcaccaattttctccctttcaccttatacattgactgcataaattatcatttcccatcttttttagtatagcggaattttgccctttactcattgggaaaccattagaatttgttgtaaattctagcgaaataagctaggagaacactgatgtaccaaacaagtaatagacaagaaaaagtcttcaagacagtaaaatatcttgaagacttttaggtgatgcatcttctatttattcacacgttttgcgatcattggtaaaatcagtccaatcaagataaagatgatcggtgtgatgatattcaatgacaattggaacaaccaagcttttggatcagcagcataatctaattttggtaccatccctaagatacaagcaaatgctgtaaataagaaacaccacaaaccaataccaaagcctagttttgtatttttaacaaacttataatctgatgagaatcgatgggcttgtttattgatcagcatgaaggctacaaatacccataagtaacgtaatggcatcacaaccgaattcaagttcaacaaccagcgatacaattcagtcatatttccgatacctaacgcaggaatgatgatcaagatgctgactaagatccctgtcatgatatatccattgatcggtgtaccttttttgttcaattttgccaaaccatttggtacaaattctggatctgcatcagaaagcaaaattttcaacggcgcatcaatagaaaatgctaatgctgaaatttgcgctaatgcattggcgatcgaataaagaatcacaaatgtattgccaatcccatagaaattgccaagacgttggaatgcttcataagcgccatttaccatcaaatctttaggaatattgtttgcatcgaacagcatccccattgcgattgatcctagtaacgcacataaagcgaccattccggctaaaaagatcattcctttaggaaattctttggcagggtttttcgtgttattaacgtaaggcgaaattttttcacagccacctaccgcaaacaccagcatcgaaatcgtcgttaagtaagtaaaatcgaatttaggaatataagttgaaacagttgtcatatttggtgttgctacttgagctccagtcatcgctggtgctgttactgctaaaataataaataagatcgacatgacaaacatcgctgttccggcaatattaccgatcatcttcaatgtagtcaatcctttagatgcgatccataaaaagaaaagaaaaatagctaaacaaattaatgagacttccattgatccgacagtcgatacgaaagagccgtttcctttaaataaccaactcaatgataccaggatcccttgtggtttttgtgcgagatatgggacgtgaacgacccagtaagtccaagcagcgaaaaaggccaatcgtttggttgaagtttctttgatccaagaggatacaccaccgcttgattccttgaacgttgatcctagttgacctacactcaatgcgtagggaacaaagtataatgccatgatcaagatccaagatacaacaacagtcaatccctgttgtgcatagttgttcactacatttccgagtccccaaacagagacaaacgccattagcgcaatattataccagcgcaattgtttctcgttcattactttctcctttaaacatatgatttcagtgatcgaaccgaattctcgaatgatcatgatttccatgtatcgagcaaagtttatttgtaagtcgaatgagctgtccacaacgctttttcacttctaacgaacttctcgataactgtcattaacattgaccagaaatggaatagaatatcattttttttgaccattcatttcgtttcagtcatcacctcattttagaataaaccccaaaattattttggtcaagagaaaataataacaattttcatcgttttttaacaatgggttaagcgatatataaataacgagataaaaaccattatttagattaaaataactcctattgcgttccgttcctttactggaaattagcacctaaacaaattttttagaaaaaagataaaacagaattttggaatttttcagacttttaactattaatgattagaaaaataattttattcacgcaagatattcccttacaccactcttcccgctaaacaaagtgaacagtaatagaaaaaaaccaacttatattttgtctagactacaataaaaacgataacattcgtcataaaactattttaactattatttaaaataacaaaaaatcttaattagatcagtttgattgacactttccgatcctcttaagattttttacgagtactaaaggtagctcttatttatcgaagtatttcctagtatcaatctcgtcttgttgcagttgttcaatcaaggcttctgcgccactaaaagcaacttgatctctcaaaaagtggtgccagcgaatcgcaacagtctctccatagatatcttgatggaaatctaaaatatagatctccactgttaattgtcggccttgaccaaaggtatcattatgaccaatcgatcccatagacggataccagcgatcacctactttaagctcggtaacatagacaccttcttttggcaggcgcactgtacttttgactttaatattcgctgtcggaaagccaagttcgcgtcccctggcatcgccatgtacgacagttccttcaaactcataaggataacctaacagtcgattggcttctgccatttctccgttctgcaaagcggcgcggattcttgttgagctgactttctcccctgccaaagtttccttgggaacggtaatcacttcaaaacggccttgggcataagaaggtaaaagtgccatgtttgctgtctctttctttccataggtataatcgaatccagccacgaccacttccgcatgtaaacctaccatgtattgatcgacaaagacttgcggcgctaaatttgcaaaagctgaagtgaaatccacttcgtaaagatagtcgactcctaaatcagccatatgggcttctttttgtgataagctggttagatattgcattgcctcaggatccactttttgaaagacaatagatggatgctgattgaatgtcatcaatgccagcttcaatcctttttcttttgctgctgcttttcctgtttcaataactttttgatgacctagatgcacaccgtcaaaaaagcctagaaccaaaacgacaggttctgatggaatgacatctttattatatggatgacgtagctcgataatttccattcttactctcctatttctgtacgaataactttcgcaggttttaatagcccctgtttcctttgatgcggcatatagatactaacgactttatcttgataaaacaatgccacaggtgttgcaggaggttcttgaagaccaaaactatgatatggcaagggcatgccattcttgacattctgccacaacttctcatcaattgcaattttgggaaacccgcttaccccatattcaatgggctgcagcaacttattgattcgccctgattccaatgcttcacgaacttctgcaagcgtaacagattgatctttggtaaagccgccgcttgctaaccgtgtcaagtcagacatatgagaggctactcccaaagcagcacccgtatcgacggctaacgtacggacatacgttcctttcccacagcttacttgaaaccgccacgattgggtgccacttgtctcatcaaagattagatcgctgatccgcttaaatgaatgaatcaaagcttgccgttttggacgctgcacttcttcatttgcccgggcatattcatacaaacgtttcccattgactttaactgcggaatacattggcggaatttgggtaatttcaccagtcaaacttgccattgcacgatcgacttctgctgtagtaaaaggttttgctaaaggcgtcctttcaacaacttcacccgaacggtcttcggtcgttgtggaaaaacctagcgtgatttctcctgtatatatctttccggaatccaccaagtattccacgactttggttcctttgccaatgcagatcggcaatacaccgtctacatcaggatccagggttccactgtgtccgaccttttttgtatgtaaaatttttcgtagtttaaagacacagtcgtgactggtttgaccacggtctttccataatggcaaaattccatccatagtatccctccgcttctttttcaacttgaccattataccatattctaaaaaaacttagtatggtcttaaagtctttcagaatgatattcgttcatgatacacttatattataaggaggtgccacatgattgtattcgtttgttcattgattggtttcatactttttttatatttggttcaacgtggtacgctgcaacaacaagaggaggcactggctttatttgttatcaagagccgaacacctgctttaacacggatgatgctcttttttacaaatttcggtaaagcattgcccacgatcatcttattgttattgctttatgtttttccagctacacaaactatcctagcgccgaaagcagcagcgagtgtcttacttgtctctgcattcgcttatctgattaaacggatcgtccgcagagaacgaccaaacgatcatcggttagtcgaagaaaaagaccacagcttccctagtgcccatgctgctacttctgccgcactttatggaactgcagcgatgaatatggcttttcttttgccacctgctgttctgcccatgagcattcttgcggtcctgctcagttttatgattgggttcagtcgcgtttatttagggatccattttttgacagatgttatcggtgggtggtttttaggattagcagttgctgcattgatcaccattttgttatgatttttggccttgcacagtatctgtttgatcattatagaatagcctcacctctcagtaataaaaaaaaggccgcgtatatgaagcgacccccaaaagttagaccaaaaaatctaacttttgggggtcgttatttgtatggcaaaatatccttttgaattaaaactaaaaatcgttaaagaatatcttagtggcgtgggcggatatagttatcttgccaacaaatatgatttccccttggccatacgcaagagtatttattctacgaacttgattgaatcctttaataagcaaatcaagaaatacagccaccgcaaggaacagttccaaaacgaagagtcgatggaacgtttcttagtctcgtcttttgatacttacaaccaaaaattcctaggtcgcagtcataaaggctttcaacaggccgaaggcgaacttgaacaaatgctaagccaactgattgagaattagaaacaatctgcagtagggaagaatcatttacacaaaattattgacgctcccaaatgagcatcccaatattcatttattaattattattcagcttatacaaattatatttcctacttcttatagactcaaatcactatatcactagatatcaaacggcgtcatacggagtcaaaaacgctgagagtaaaaaaatatacagccccataggtaaagtgccacagggctgtatattttttatttcagattacctgaaatgattccatttaatttttatctcattttttcctactagttagtatcaaatactcccctattttctcaataaactattttgggttacatggtatctgaaacagctaaaaccttgtcattacagtaaaaaatcactttatctccgtttcatttcagatacatttcacttaagcggattccaaaaaaacaaaagaaaaaggaacccctagttagcctatgctttttatagattcctctcgaaacacggtcatataacaacggggtggggtaaatgaatgaaaaaggtggaggaaacattattcaatagctgtcttaaatacttcgttataaaatatgaacaaataaaagacatctatccctattttctacacttccactttactaccatctttgaatcgtacaattttcttaactcttctcgtttacctcaattcattttcaagtggaatcaacttatcatctaacattttacgccatgctcgcttcatttcttgtgggtatttaaatggcttcgcttctggatggttggctttatatccttcgtaatccttactgttgataattgctttcatattaggaattggatcttcacctggcatatattgcagattagaagcatgtaattctttctcagaaacaaaccactcattggaaaaggtatgaatcaaatcatcacttgcttgtgtaaaatagcgacgtttaatgacaaagatatcttcattactatctaaagtccccacatcaaatgcatttaaaatttgtcgataaacttctttgactccttctgttttattcaatttagccaaagctttttcaatttcttctcgtgcatctgaactattcgcagcataagttcctagtaattgatcaatataagtagaatcaatatcatacaacttagtggtattttcactataaaattcgatcgttgaaaaatcttgtcctttattttctgattcttcctcgacttcaatcaaaaatcctttcactgtctggtacacaccaatttgttcttccaaaagttgaatttgattattcaaagttggggatttcaccatatcatcattataatcgtcataagtcactaacgattcatacgcacgattcaattcttggaatgctttgacatattcgatacgagtttcaagaggagtatgttcatcaatggattccatggatgaaacctcttttaacttacgatatgcttgcttgaatctttttttggattcttggtaacttggataaatcaaacccgattcttcttttgcttctgaatacagttttgtcgcatcctcgacattcttctccattgtcgctggcttacgaaacgttacaatcaatccttttgtcttttcaggatacgtacggttcgtacgtgaaaaagcttgaatcaatcctgcatactctagattacgatctacaaatagggtttgaatcgtaggtgcgtcaaaacctgtcaatagacgatccactacaatcactaaatcgatttgtttcccaaattgtttgaattccgctctttttcgtgccaaacgattattgatgtctccgttataacgctcaatgtctgctaatgaccaagaagtatcataatactgattatattcctcaataattttttgcatttcttcttgttggacacttgaatctcggctgttttcttctaaggaataggtaatagcgattcgtggaaaatcaggatcctccatcgttcttccttcacgaatgggctgattaggaaactcttttgttaaccagtcaggttctttcgtcatttctttgatcgctcgataatactttttggccatgtcaatggaactcgtggttaagattgcagatttcgttggcctgccatttcgaaaatcaaattttgtataggcattatctggacggaacattttatgaatgactttttggatatgttcatctgcttcaaaaacagctgggtccaaataactttcttttttgacaggctccatttgatcaatcatacgattgatctgttctgatgaatactctgcatatgtttctacttcttttaatttccgatagattttattctctagtgaagtcggctccacggtgttttcatgctctacttgaaatcctaagacagagccatcttctagcgcattcttaatggtataggtatgcaagacctctccatactgatcatgggttgtacgtgccaattgccctttggcttgtttccgattctcaggaaaaatcggtgtacctgtaaagccaaaccaagtggatttcggaaacatttttttgatttcttccatattttcagcacttaacgctcgatgacactcatctactacaaacacgatatgttggcccattaatttttggaagcgattggttccttttttctcttcttgtttctttgcatatttcaacgccgcatctagtttttgacgggttgtaatgattacaacatttgcattggcatctgccaacagggtttcacttaattctttggcacttcccgttccaacgatcaagctattcgctttggcgttcccggaagaaatcccagtattaaattccgaagcaaattttgtaaactctgtggtggtttgattatctaaatctttgcggtccactaacatgatcgttcgatcgatccccgattttcgtgctaaaagcttagtagatacaaaactagtcaacgtctttcctgaaccagtcgcatgccacacataccctgattgatgtttatttgcggcaataaacaaggcttgaatcgcatgtacttgataaggatgtaacaccatgagggttttattgtcttgatcttcactgacgattgtataatccgcaatcaaacgatgagcatccgggatatttaacacttgtttacaaaactcatataagttttctactttttcattgtctttcgttcgccaactaaataaaaacttagggtgcaagtctttcggtaaggcatttgcaaaataccgagtggtttgttcattggaaaccacaaacaactgtaaggtcgaaaagatattgttccgaaacataccttcttctgcatattttttgatttggttaaatgcctgataaacaccatcttttgcagttacttgtttcagctcgatttggacaatcggtaatccattgattaataaggtgacgtcaaaacgtcgatcccgtgcttctatgttacttccacgttttgcaatttgatggaccacttcataagtagagattcctccaccaatgtcttgattggaataaaggataagtgagacagaacccaattgcgaatcttcccgttcaatcgtgatccgagccatcccattttcaccttttaaccatttcgcagcatcaaatggggttttcgttcgcagcagtaattccgttttgatcgtttcaaattctttatcggtcaaaggaaaatcattcagttctgcttgattatttgagataattttttggcgtaaattgacccaaaggtcttcttctgattttagatccggacgatacgtccactgattatgcccttctccaagtacacgaatcaactgttcttcgacttctgcttcctcacggtgactaattttcattcttcttccctcctagacaaacatcttttgtaagaagctttttttcgtttcttttagtaaatctaacttacgttgatgaagagcgatcgtatcatctagctgtttgaagaaagtaccgattttttgttgttcatcctttacaggaaccttaacactgatattctcaatatcagaactgttataagaaggcaatgcccctacttgggagtatcttggcaaatttatagtttcaaacaatattttaccaaaatagatatcccaagtattattaaataaataagccatggtattgttatctattaagaaagggcttgtgaccaaacgttttctattaagcattattgctgcgccaactttagcaaatataatcgctggcacatcttttattggcttccattttttacgctcaatttgctcattagatacataatgatttgcatttctcatttcatactcattaccaatgttattcatgtcggaaactttaaaaaatggagtaccttcagaaccaccttgctcggcatcaggaaatccaattcccgattgagttttacctaattctcccaacttacgctcttcccaatcttccgtaaaaccaggaaaccggatttctggcacttttgctccgttttcagggaacattttttgtaagaatccttttttcgtttccttcagcaaatctaacttacgctgatgaagagcgatcgtgtcgtcaagttgtttgaagaaggtgccgattttttgttgttcttcctcactaggaaacattgctactatatttttaaacttttttagagacagaacatgttgacctgttccctctgcttgaatagataattgtcgttggattccattgttaatacgtcttaagaagaagtcggaatcagcagattttaaagtaaatacaggataaaaatagcttataatccctctatcaataatgtcattacggttaaacacaaacacatcattatcacttcgactacggaacgtgaaatatcctctaggtagtacaaagtaaccaatattattttctgtagttacttgccgatttgcaaaatagtcttcttgcaaaactatccctttttgttgagatgaagttagcataggaaattgattttgtacacttgtcttttcaacataatctacaacgaagtcccccaacttcctctgttcccaatcatctgtaaatcctgggaaacggatttctggttgtgtatcattgctcatgtttgaacacctccagcgcaccttgtaaccacgcttcattttcaggtgttgtttgcagggaagagatagcttctaaaagttttttttctagcacttgctgttcttgtcgtatcttcttgatgtcatttccgacatgaaccatatcaattggttcttcttcttcgaaagtatctacatagcgtgggatatttaagttatagtcattttctttgatttcatcaaaggttgccaaatgagcgtatttctcgacatcttttctttcagcgtaggtttcgaggattttttgaatgttttcttccgatagtttattttgatttttccctttaacaaattcacgactagcatcaatgaataatacatctcgagtttgacgattcttcttcaacacaatcaccgtcgttggaatcgatgtcccaaagaacaagttcgcaggcataccgatcacagcataaatactgccatcttctagtaatttttgacggatgaccccttctgcagcgccacggaataaaactccgtgtggtaagacgatggccatggtacctgtttccttcaaatgatagaacccatgaagaagaaacgcaaaatctgctttggattttggcgctaatttcccataacgattaaaccgagaatcatctaagaaagtcgtatctgctgaccaattagccgaataaggtgggttcattactactgcatcaaatgtgtaaggttcatctgttggccagtccttattcaacgtatccccattgcggagattcatttcttcggcgtcgacaccatgtaaaatcaagttcatttttgctagattgtatgtcgttgtatttagttcttgcccatgatatttaacgttatctgggtgtgttaagtagttacgtacgtttaacatcaatgaacctgaacccatcgttggatcaaaaacactaaagaatcgtcgttccttttgatcgagcgttacgatttgcgccatcatatcagaaaccatatgaggtgtgtaaaattctccggctttcttccctgcttctgaagcaaattgactgatcagaaactcatacgcatccccgatcacgtccccatcgtgttctaaaacatctacatcattcaatttcttgatgacttcggtaatcgtcacatttcgttgttgctcatctgttcctagtttttttgattggagatccacatcatcaaataacccattaaattgattgtaggtagatgccaattgcacaaaggctttgtttagatcgttcaattggaacgttgcttgttttgcttgatccgctaagacgttgaaaagatactctggtgcaattgcatatcccaaaatatcaacgattgtggcaatcagatcttcttttgattcttcatctgaaagtaattcacgatacaacattgtttgtttgcttactgtgtcatattcctctaaggattcatctgctaaaagaaccacttgttccaacaatcgatcggataaatatttatagaaaatcagtcccaataaataatttttatattctgacgcatccattttactacggagattatctgccgcactaaataatttttgatttaattctgcacccaaaaagatacactcctatctcttatttaaagttgctatataccctcttattttagcatacccccttttataaaaagcaaaaaaaaaaaagaaagaaacttattcttgctaataaactacgcgaaaggagtctaacgttgtttgatataacttagactgatcgttaacttattttttatatttctacatagttatctttagaaccatttcagatacatatgaaacaattacatatgattttttcataaaaaaacagtactgtctagtagtataaaatatacaaatttcttaaaaattttttcactaaaatcactacctgaaacagtctaaaacacttatatatcaacgtttaatgaaactatctccgtttcatttcagatacaaataaatatagtcgggctccaaatccgaaaaaaaatacccccagtagcttatcctaagctactggagatgtataagtacggtcatataacaacggggtagggtaaataaatgaaaaagatggaagaatcattattcaataacttttttaaatacttcgttgtaatcagttacctgtccgttcttaaataccacagaataatcttttttcccattttcaagtaaccgaagtggaatatctttaccaacttgctctgtcactgcattactgatacctgttagattagctaataaatctgataaagattgagcatctgtagaaatctctgtattagtatttatcgtgattcctttatcttcatttacaagtttccaagtaggtggtatagctgtgtatgtttccacaaatgaattaagtttttcattaagtgacttctcttttatatttccatctaaaaactctgtatatatggcttgagccatactaaaacaaagctgaccttgttccaataattttacatcgttagttagtaaagctgtgttcactttatctatcgcttcaagaagagtatctttggtgtccctaacagctttaggagtgccttctggaatttctctacttgatacctcgtccattttatcttccataaaacccttaaattcgtatctttctcccaaatccataaaattttttgataaagttttcatttctgagtctatttcttcaataatatttaacatgtctgatacatattgtttaggctgattcgtttttaatctatatgtggtagatatctcaatccctccaatcatcaataaaattgccaaacaaatccataataattttttctttttcatttttcctcctatctactgctgttataacagtgactaatgtaaagattttcccagtaatcattagactattatttacagggaatcaaaaaaactccttagtaagcttacacctttaggagttcctgtttggacggtatgcataatacatttaaatcaatttaacattaacacctcagtatatggtatctctacatatacacggtctttttttggatagtactcgacatttatattgatagcacttccattgtctaacgtagctttagcccggtacgtgttatcaccattatcatgagtgatcgtcacatcatcacatgtccgatttaagttatactgttcttgtaaaatctgagttaccaatggtacagatgacttctctagtccagatgaacccgtcattcttgaaaaaattatacctataatagccaatacgacgatacctataatgacaaacttcttgttcatatttactttattcaactttttatctcctatctccaaaataatttgcttttatccctcttatcagtacattgacatccctaaaagtacaccaaagatggctccagctacccctgctatcatcaaaatcgtacccatttgttcatctttatctcgatataagtagcccataataacagcaacagcaccaaatacaacaggaataaatgctaacgatactaccatagaaatccaaccaataatcaaatacagcttccctgtctcttgtccatgtacgatttgttccttcatttcattaattgtctgctcagtacttttctttactgcgtctgctccagttgtctcatctgtttcttgtagtgctccgcaaaactggcaatacttactttcatctgttatttctttgccacattttctacaatacatgtcttctcctcctaaaaacattcaattgtttattagttaactgtttactttattaaatacatcagaaaacagctcattcattggtacacttaatatctcagaaagcatcttcatttgatagggtttaggaatcgttctccctgtttgccacgaacttacacattgctgtgtaacattcattttttttgctaactccgtttgagaaagtcctttttcttttctgtatcggctgagattacttacttttttcatgattctcccctcctgttttattatatacaacaatatgatgtatttcaactcataaaatataaaaaacttcaaataccattacaaatacaacaacttgttgtactatactgagatgggggtgtattaatgaaacagaaacaatatgcaaaggtcattagagaaaagcgaaaagctctcgggtggacacaaaaagaattagctgaaaaaatcttctctacacaacaggcagtagcaagatgggaaaattctgtaacagagcctaacctcgatagcttaacagctctttctagagccctaggaacccctgtaagccattttctagacaatgttgtcgtagattatgaggaagagtttttggctctctatcgttctcttagcactgaagatgcagttcgaacaattgactatatgaagctattaaaaaggcaagaaaatgaacgcaatcagctattgaaagattgaaaaataaataacccaccgaactttaacggtgggtgtattgagatgaaataagattaagagctatggataacctgtctagtttaatacaattgggtcttttctcttccttactctccgtccatcatctcttgttacacttgtaaattgataaagaggaactaattcaactcctgataatatcaattcttttattacttcatctatccctgctccttttgctaggtagactaaaaaactactacttgctttcacattgtatagtctcttaatatccttagaagctcgttcaagagtgaatccttgtttaacaaagtagcctctgttttcttttaaagcattttccacgctgttattcccaacattacgtagacgttcacaaacagtgttagtaagttctttctctgtcattatatatgttccttgccacgataagccctgtaaaacttcatgtgcctcatctagaatcaattgtttttccttgctaagttctgatcgggaattttgcgggaatacttttttagcctcttcctcgctaaagcacatcttaacccaagcataagaaaaatgttgatatataaagtggtatttttccagtgagggcataatattttcagtcaattcttgaatcacagaagttgcattaaaggcatttagtcgatagacattgcttctcttataactaaagttcccacctttttcacgtaacgctttatctttcttttgcttattcagatactcgagcatatccatagggatatcatcgtcatctagtttttttatcaaacctataaaagtcataaatgataataacttattccatttacctactgaggaaacactctcttcaccatagtaaaaagacatttttttagctagttgttctcccgacataatacaagtcaagcttcctttactgtagtcaagaaactgaacatccaaaagcaaggtatcatagacacgtcgcatttcctctagataattctttattgtcctgaaaagcttgtcttccatagattcaagagtgtcaaaaagtacttttgattcctctttcaattttcgaaaatgtgtaggatacaggtctaggttctctaatagccaattaaaggcttctacccgactatctttctttagaattaacatcacaaccccaataaaatctacactgacaccacaattactagaatgacaatgaaaaatggaatgaccacttttcccggtaaaaatactagcagagggattatggtcgtcgtgaaacagacatcttaagtttttacttgacttaagtaatttgttcatatcaatggttaacaatctttcataaatctcattaaaagacatgtcggagggatcaaataagcaatctttaaaccactgttgcatttcttccctgtcttcattctttattaacttaacaaaatcggtttcattgactagttcatactctctctctgaatcactttgaccattttttgaacatgtcatagtgaagtcaatcggatgctcagtaatatctaacatgttgtcttcatcaattattatgactgcatctgacttatatcctccaaaaaacattctattcgaagcctttacattgtcatcacacccaggtatgttctttttcaagtattcgtaaacagaaaccattttactatgatcagtaatagcttcttttagaataaagataattttgaatttttctagatgttcagagtaccggatgcttttttgtatcgcaaacgcaaagttacgaactaaagagatagataaagccttttctatgcttaagtatctactatcatctttactcaaatctactacattattattctcatctttaacagtgttatcgacatccagaataattactctagtttctacaaagtcctcagctttgttacttttattctttgtcttgcttggaataaaagatagtgatgaatttagtatctctacaaattcatctcttgcaacttctctatagttatctaaacatctttctcttatatcagttttttctttttttgtaactggcttctctaatagcttttcttgatctacataaatattaatcactggtatttcctcctaataaaattttgataaagactaaaacatatagataataaaaacaaactctctattactatatgttttaatcttatttgtttactcaacctttataccgttccatgaaactatcaatatcagattttttgaatctaatgaccgtatcaatttttataacaggtaacccgtattgagaaacatattttctaatcgttcctactgatacacctagatattcactagcctgctggtagtccatatactctagtgtgactccagaaataatgtcttctagcataggctttagcactgtaattatctctttcacttgttgttcaacttgtatagagacaatgctatcaatgatttgcagggacatactttctccctcctttcgtgattgcttgaacaaatttcctaagaaaacaaataaataattatcttcgaattatttaatcaagataaaagtattttttcattattaaccgattaatcaaacaaaaaatgattaccggttcatcaaatgataaacatatgatacctcgataaaataggggtgtcaataattattaaaaattgttttacaacaccccttttttggtgtatactaattttaggaggtgtggtcaatatgataaagcgtccaccaataaattgtttagaacgaaaaaaaatactcggaacaaaaataaaagctataagaaagagtaagaaattaacacaaccagcattcggtattatgattaacaatggtcaattgattgacaaaaaaactgtctacgaatgggagaagggaacctatttaccaaaaccagagcgattatctcgaattgctgatttgggaaatatgagtatagaggagttagtttgtggcagtgtagaagaatatattttcggaattattctttatggagatagcattgtgttagatggtataacatttccgaataaaaatctgtcacagcatctttatcaacagtttccaccagtacaccccgatttagataaatggctgaatagatattccaaattagaaccagagacgcaagaatttattgctaacaaaacttgtaataaagttaaaaatgaaaaaattagtcttttcaatatcttaaaaatagaaaaattattcatcaatgctattgtagaagaatttgacaataacattcttttcctcactagcagtatagaagaacagctaaaaataatggtagatgaatggctacctagtcaattggaagacatgacttatcccaaagaagctgtgagagaaatttttgataatataaacaagctagaacaaacgatttcatcaattggaaaaaaatacactaagaaaaaaatgaagggaggtgataccatctagtggtaagtactccttgtaaactaagaggagatgatataatggcaaaaatatcaaagtacaaaaagaaaaacggtcaagtggcgtggatgtataaaggacacattgccaccgatccacgaactggtgaaaaaataaatactactagaaggggttttagtagcaaacaagaagctcaaaaagattatgacgaatacagacatcaaatattatatggtgctaaaaagaaagaacctgatatgacatttgaagacctgtataatgaatggatcactcatcagcgtatcagtgttaaagcttcaacaatcgcaatctcagtaagatacgcaaataatcaaatacttccagcatttggtaagcttaaattatcgaatatctctgtcccatattgtcaaaaagtggtagataaatggcacagtgaatatgaaagttacgactacatgagaaagcagactgcacaaattttacgctacggggttgcaatgcaatatattgacaataatcctatggaaaaaacacttcttccacgaaaaaaagagtatgagaaaaatcgtaaattttactcaaaagaggagcttaataatttactggatgcttttaaagattttggtaacatgaaacaatacgccttcttcagattattggcatacacaggtatgagaaagagtgaagtactcgctctacagtggaaagacatagacacgtttaataaagaactacatgtcaataaaactcttgctgtggatgaatttggtaaagttataattcaatctccgaaaacaagagcttctagaagggttatctctttagatactgagactctttctatcctcaacaactggaaattacaacaaaaagaagagtgctttaaacttggctacaatactagctctaaagagcaacatgtttttacaacacttaaaaacactctgtacattccaaacactgttaatgattggctaagatatattttgaaaaaatataacttgcctcgtattacacctcatgggtttagacatacacatgctagtttattattagaagcaggtgaatctgtcaaggtagttcaacaacgattagggcatgaaaatagtaaagtgacattagacatctatgcacatattacgaataatgcacctaagaaaacaggtcaagactttgctgatatgatggctcatcagtaaaagagctggtcaaaagctggtcatttctagtatacaggtaaaataaaaaagctagaacccttatataccaaggattctagctcctataacaagtttatcctacactgccttccatctcataacttatcaatcggtttagctcgacggcgtattccattggtagttctttggtgaatggttcgacgaagcccatgacgatcatttcggtggcttcgctttcggataggccgcggctcatgaggtagtagagttgttcttctgagatttttgagacttttgcttcgtgttctaatgatacttggctgttgtggatttcattgaatggaatggtatcggatttcgatagatcatccatgatgatagtgtcacattcgatgtgagagatagagcctgcgctcttcttgccgaaggtgacttgtccacgatagtttacggcgccgccgtcttttgaaatagatttcgagacgatggagctggaagtgtttggtgcgttgtggatcattttagcacctgtatcttggatttggttcgcaccggcaaatgcaatggagagcatcgtaccgcgggcgcctttgccatcgagatagacacttggatatttcatggttgttttggcacctaagttgccgtcgatccattcgactgtggcaccttccaatgcttttgctcgtttggttacgaggttatagacattgtcggaccagttttggatggttgtataacggcagtaggcatctttcaaggtgaaaatttcgacgatagctgcatgcaaactattactggaataggttggtgcggtacagccttccacatagtggacgctggcaccttcatcaacgataatcaatgttcgttcgaactgaccggtgttttcggcattgatccggaaataggtttgcagcggtacgtcaacgcggacgccttttggtacatagataaaggttccaccggaccaaacagctgagttcagtgcagccaatttgttatcggttggcggtactaattttgaaaagtattgcttgaagatctctgggtattctttcaaggctgaatcggtatcggtaaagatgatgcctaacttttcaaactcttctttcatgttatggtaaacgacttctgattcatactgtgccgaagccccggctaaataggcacgttctgcttcgggaattccgattcgttcaaaggtttctttgattttttctggtacatcatcccagtctcgagctgggctgtcgctaggtttttgataatatttgatggcatcgaaatcgatgtcggacagatccggtccccagttttgcatgggcattttgttgaaggcttctaatgacttcaatcggaattccaacatccattctggttcttgtttgacccgtgagatttcacgaacgatgtcttcggtcaagccttcaccggtactaaatacgggctgcacgtcatcgtggaagccaaatttatattcttctaattcgggtacacccatggttctcactcctttgttttgctgcaatctactctacttgatgctcatcggtttccgagtgtctgtgttccacatctgattgttgggtatcgtcggcgatcgctttttccaatgctttccatgcaagggtggcacatttgatccgcgcgggaaacttagccactcctcctagcattgaagcatcacctagacggtcactgtcagaaacagtatgaccttggaccaattcagaaaataaacctgacaattctccagcttcggtcaatgttttgccgatcactgcatctcccatcattgaagcactggcagtgctgatagaacagccttcaccggtaaatgccacgtctttgatggtcttcccttcaacggcgagttctaaatgaatcacatcgccacaagtgggattattcaattcaactttataggtagaatctcctagtgttccgcgatgatgggggtgactggaatgatctaatatgacttgtcggtataaattatctaatttcgttaatgccatgttggaaaaactcctttgttaacttgatggcgtcaaccaatcgatcggcgtcctctcttgtattatacaggtaaaagctggcacgtgcagttgccggtacgtgcaaatagtttaagaggggttgtgcacaatgatgaccggcacggacagcgacaccttccatgtctaatgcagtcgctacatcatggggatgaatcccgtcgatgttaaaagcgatgacacctgttcgtttggctgcttcttgtggaccataaatcgtcagtccatcaatggcttgcaattttggcaaaacataagcgaccagttcagcctcgtgttgatggatggccgctaacccaagttcactcaagtaatctaccgctgcccctagcccgatggcgccagctatgtttggagtacctgcttcaaacttccatggcaattctttccacgtgctttcttgaagatgaacgaaatcaatcatttcgccgccaaattccactggctccatctgatctaaccaataacgtttgccatataagacaccaatgccggtcgggccgcacattttatgaccagaaaaagcatagaagtcacaatctaatgattggacatcaactgacatatggggaactgcttgggcgccatctactactatcacggcttggtgttgatgggctagttgcgttaactcagcaattggattgatcacaccaagaacatttgagacatgagcaatggcaaccaccgctgttttatccgtgatctgttgacgtgcatcatccatgtcaaggataccttctggcgtcaattggatatatttcagaatcgctttcttgcgttttgccagttgttgccatgggatgatattggaatggtgctccatgtaagagatcacgatctcatcaccttcattgacaaattgatccccaaaactgcgggctacccaattcaggcttgtcgtcgtaccacgagtgaacaacacttcgtcggtttctttggcctgaataaaatggcgaactttttcccgcgcggcttcataagaatgggtcgcccgttccgccaatgtatgaacgccacggtgaacgttggcattgtcttgatgataataggcagcgatcgtcttcaaaacggcttccggcttttgggtggtggcagcattatcaagatagactaatggctcatcattgacgacttgatccaagataggaaacgcttgtttcactttttgggcatcgatcatgcaagtaacttcccttcaataacagccaccagttcttgttgcacttctttcacaggaatggctgttaagacagatcccagaaatccgcgaatcactaagcgttctgcttcttccttgcgcaagccgcgactcatcaagtagtacatttcttctggatcgacacgacccacactggcagcatgtcctgccgtaacttcatgttcgtcaatcaatagaatcggattggcatcgccacgagcttggtcagacaacattaagacccgactttcttgttgggcatcggcacctttggctccttttaaaatatgtccgataccgttgaaggtcaagacgccgcgttctctaatgacaccatgttgcaaaatgtggccgatcgaatgtggtgctttatttgtcactcgcgtatcgatcccttgtgtttgccgaccggcactgatagcaacagcttttacttcagaatgggcgccttcgccaacgaggtctgaatcaaagtcagcaatcacatcgccgtcattcatgacaccaatcgcccaatcaaccatagcgtctcgtaagacatagcctcgtcgattcatataggtagtgatattgacccccaattgatcaatagctgagaatttgactttagcccctgctttggcgatcacttctacaacgatatttccagataactttttggcttgatcccctttggtttggaaacgttccaagtagctgaattcactgtgctcatctgctacgatcaagacatgcttgaagaaatgcgcttggctattgccattatgatagaagattgcttctagtggttcttcaatgatgacattcttgggtacatataaaaataaaccactattcataaatgccgcatgggccgcagtcattttgtcttcatccattgggactgctttagtcatatagtattgattgacgagttctggtacttctctcattgcggtaaacaagtccgtaaaaatgacaccttgatccactagatgttgcggtaattgttcaaagaccgttgtttcatcaaactgaacaaccgttggatggctatccattgcatcaaaggatggaactgcccccaatcctgctgccgctggatcaatcacgccagagaattcttgttcaccgacaagtgctgcttcattgatattaaacaaaggccagcgttcataacgaacccgttcaatttttggaaacgggagttcatccacttttgcaagggctgcttggcggagttccaacatccattcaggttcttctttcaacgctgaaaacacgttgacttggtcaagataatcctgtaattttgccatttgccttgcctccttatgcttcttcttctttgtagtcgatccctaattctttactgattacagcatatccttcagcttccaggcgtttcgctaaatcagcagatcccgtcattaccacgcgaccttccatcatgatatgtaccacgtcaggagtgatataattcaacaaccgttgatagtgtgtaatgatgagcgcgccaaagccttccccgcgcatttcattgacccctttagcgacgactttcaaggcatcaatgtctaatccagagtcgatttcatctaaaatcgcaaatgttggttctagcatcaataattgcaagatttcgttccgtttcttttccccgccagagaaaccttcattcaaatagcgttctgccatttcttctggcatgttcaatagatccattttttgatctaatttctttagaaaatccatgacagagattttgtcctcttcatcccgtttagcgttgatagcagctcgcatgaattcagcatttgtgattcctggaatttcactagggtattgcatcgccaagaacaaacctaaacgtgctcgctcatccacttccatttccagcacattttccccatcgaacaagatttctccttcagtgacttcataattcgggtttcccataattgctgcagataaggtagattttcctgtcccattaggtcccatgatggcatggatctcaccggtttttaaaacaagatcaacaccttttaagatctttttatcttcaatttggacatgcaggtttttgatttctaaaactgacattctgttccctccagtatcttttctttctcactattttagactaattgagaatgaagttcaaacgcaattgcctacttttttaaaattcttctaatctagcccctagagatacattggaatcattacaaactgctgtgaggatcccctttgaaagaaactaaaaaaagacaccctcagccccgacgaaagcatgtgcttttgtctttaggaacagagggtgtcctacttgaaaactctaagcttgcacgagcaaaatgatgcaatcaaaaagaagcatcaacatttgcaagcggatgatagagttgattcattaattctgtgtcgcttttacgtccacgattggatagtaggatcacgctggttttgttgtctttagaaaacaacccaaacgattcgaatcctcctttaccaccatgagcccgaaaataagtccctttgtcataaaaacctgcggcataggacccgccagcggctggttgccacatttgcttcagtgaagctttatccagcagtttcccattcaataataaatcataatagcgatacaagtcgccaactgacatatagagatttccagttcctacctcagctgccaagttggctgaggaaatattgttagggttcccgtaaggatctgcttcgccatccgttttgtaattgaccgtaggatgatcctgctgtaaaaaggctttatacaagaaagattgtttcaacccattcttattgataaaaaaatccgttaacaacgcatcataactttttcctgatacttttgtcaaaatacctgccagtaaattgtagttgatgggactatatttgaatgttccttgggttccggataagacagcatgggtggcatcccagtcgaggatctgttgcacgtcttccagcccttgcggattttctgaaagtttgagtccggaagccatctgcagcatttgctgaatcgtaatcttggcagcgcctggaatatacggataaaagcgcgctaatgtatccgtcaaggatagtttcccttccttaattgcccgcatgatcaagaccgccgtcaatcctttttgcatcgagccaatattgaataatgttgccggggtgtttttgacatcagctgctttgtcagcatatccgtaccctttgtgcagcaggactttcccgttttttacaaccaatgcacttccaataaaaccactggaaagaattttctgatcgtagctggctccttcggctgtgacgacttcttggtcactaatgagattgtcatagttccccgcatccaacaagtcctgtttcttgtttgcgggttgctcctttttggaggaggagctgctggcagtactggaatgtgcgacttgctcactgtaatgatcagaagcagccgttggttccgttggcaaaaacaagtagtagatgccaatgagaccacaaatgattaccaggatatcgatcccaagcaatagtttttgaacgtttctttttgagcgtctttttgagcgtctttttgcatgtcttttcgtatgtctactcattgaatgaagcctccagcatccctattctccaacagtcctcctttttcatttcccctgaatatcttttggtgcctcttgctgccaatttttggagagaaaataatggttgatttcatacaacggtttttctttgaccttggaatccaagaatggctgaatgtattcatctgctgccaaccagccacgccagcctaagtgaatcgtatcttccatgaaatagggttgattgcccttcgttgataaatcagcgatattcatgaagccctggcttcttaactggtagcggatctttttgtcaaaaccggacaacacctcttgcggcaagccggtataatccatccacttctgattgatgggcggaatcacaaataagacatccacattgttgcgagcaaattctgtcagtactagttgaaagtcgctatattctggtccaaaacgataatcccatttcttttgagagcctttcattttatctatgcggctttgcagattatgttggtaaaaagaattcttgatccctaaagaattattagtcgtttctgcttttccttcattatcggctacttgttctatttgagcgagattataggtagaaggtaatttctttgcagcagcagtgattttgtcagtcaagttgtgccccaacccaagaccactaaaaagctcatcttcccgtttcaaaatagatcgttgcagatcaatctgttttttctgccaatcagtcggtatcttaccggatttcacttcattcaagacttgttccgtcaagctattttctttcactttcgaatagtctaagagacgttcggcatagtattgatcggtgtcagagactttctttaacgaagagagccaatcgtacacatgctgttcggaataatgatggttgaaatagtctcctttcaaccctttaggaacgaaccattgaggggaaacgatgaagactgcttttttccctgctaattctttcgccattgattgaatgatggcgtactgggtcagcgactgggtgccaggtgcaccaatcaaaaatggcgtataagaacgttgatatttctgcgacaatacggaaggatgggtggcactcacacggtttaattcggatgagccaaaaaatgggacatattttcctgttgctattgcctcatttttgatacgatccccgcgaaacaccacatcattcattgccgtcgccgcttgagcgatgactttcggatcgtagctattgatcttccaagggccaaggaagagtaccccgacaagaatccccacacaaagaagcggtccaaaagccgtgagtagtcgttttttcatcatcggctttgcagcgtgtcgactttctcaatgatttttgctggtgtattccactctgcccggtcaaattccgatacgggaaattcaattcctaactgcccttctagttcaaccagcaattgaacagatcctaatgaatctaataatccttcaccaaaaagatcgattgtttcgttttcttttacttcatcacttcctgtaactgattctaaaatgtctaatactgcttctttggttgtcatattcttttctccttttatttaacgaataatttgtccaagattcctgagaaaatcagaaaactaaagcaaactgcttggaaggtcaatacagtggacaccgctttggttaggttgttcgatggcagatttccttgttttttcttccaacggatccacgcatcatttccgcaaatcaatgtcgcatgatataccccgtataaaatgtaataccaggtaagtccatgccaaatgcccattaacaaaaagagggcaaaatagccgacattggatgcgacgatacggcttttgaaaactttcttcttgatcagtgtgaacattaaacgcatgtacacatagtctcggaaccaaaaagacagactcatgtgccaacgattccagaattctttgatattaggcgccagaaaaggtttattgaagttagctggtgtatcataacccatgaagttgctgacaccaatcgcaaacaaactatagccagcaaaatcaaagaacagatacatactataaacatacatataactcagcattccccaagagaacaagccattttgcagggcttctttggttacgatcggcagtaatacttgaccgagataataaccaagaatgaacttatacaggagccctagcatgattttggcgactcctttgtttaaataatcgagatacacttcttttgtcggcggattcagcagatccttctcaaagcggcgatatcgatcgatcggacccgaagaaatcgttggaaagtatagtagaaactggatataacgccaaggatggtattctttgatcagtccatcccgtatctccataatcatttgcactgatttaaaggtcagataagagatacccaagaaataaatcaatgaggcatgtccaacaaagaaaggggtgactttgctcaatgccaatggtaaaatcgctgctaccactgcaccataaaagacgcctgaagtatttgctcgttggcgatgctgataatagccatagacgagtaatgtctgatacacgacgtatccgatcagcgctagcccctgttgccaatattcaccaccaaaacttacgtacaataccactagtgtgagtaacgtttgataccattgccaacgcttttgtttgaacagcagcacaagcatcatcggaagcaatcctaccattagccaaatgaaataggtgggatttgcataaggaatcatatgctgcaggttcatgaaggattcacctcatttgtcagccatttgcggtcgattttgccatttgccgtatgaggcaactgctcaacatagataaatcgctgcggaatcatatactccatcactgtttcactcagtgaagatttgatggcttttgtcagttggaactctttctcgaatgggtgcgtttcgggaacgacataagcaatcagctgttccactttcttttcttgatatttagggactacgacggcttgtttgacccacgaactattgcttaaatgatggtcgatctcttctaattccattcgatacccatggaacttcacttgaaaatcaagacgcccttcataatgcaacaaaccatcttccgtcattctgccactatcgccggttcgatacgctggttgcccttcatggacaaaaaatgcctcttttgttttctcgggattgttcagatacccttttgacacgctaggaccactaatgatgatctcacctacttgccctttaggaactagttgatcttcttccataaagaaaaccgtcgaatcttctttcacatacccaattggcactcgatcatattgctccagtaattcttcagtgatttgcactccggatacggcaacagtcgcttcagtaggtccataggtattgtagatttttgcatttggaaaacgttccagcagtgcgtgagcggttttttttggtagttcttccccacagaataagaaacgttccaactgaggaacgtgcatcccgtcaaaggtctcttccatcaaacatagtttcataaatgaaggtgtcgagatccaaacattgatagccaattgcggcaaggttccaaacaatgttttgaagtcattaatgaccgccttttttaaaggcaccaaacagccgccagaagtcaatgctggatataaccccatgacagagagatcaaaggaatacggtgcctgtgccaaataatgcatcccttcgcgtaaagaaaaatccttcaatgtccattgcacgaaactcaataaatttccatgactaatctgaactcctttagggatgccggtcgttcctgatgtgaagatgatgtagtaaatatcatccttccctagtacttttgtagtgcctaaattgcgcccactttgatagatttcttccaattgatttatttctagcattggaatcattgtttccggaccttgccagtcagctacgctaatgatcaaatctggcgtaaccacagagaggatcaattcaatacgctcttttggcgtggtactttcaatcggaatatatgcccgacctgttttggaagctgccaaaaaggctgttagcatgtcaaattctaactcgccataaaccacgatcggtccgcgagtttccagagtttcctcgagataggcagctaattggtcggatcgagctgctaattgtccataagtatatgttaggtcatcttctcggtaggcaatcctctctggatccttttgtgcccattcttcaatggcttgcacaatatttaccacgttcatgaacattcctcctaaaattcattatagataaaggtgccaccttgcacgtttttataatgataaagataaatcagcatcaaaatgatacagaaataaaaaagggttttgcctgcaaagaagagtgcttgacgcacatgttcatttttgattcgttgtttcaccaaatccctccttttcttgctatattgattctagaatgaaggagtaaataattgaccttgaaatgttaaacaatttataaactggcgataaactttttatttcatttattagttttttttaatctgcttacatttttgtaatacaaaatggctttcacgaacaaaattgtcatctcttcataaaaaaagcaagaatctctttaaacagcacctatgctgaaaaaagattcttgctgctatattttttggcagcaactaaccactttgctgcaatgttacgccttaaagcgataccctgctccccagacggtttgaatatattgtggattggtgggatcttcctcgactttttctcttaaacgattgatatggacggcgacggttcggatgttgcctagtgcttccatcccccagattttttcatagagttgttctttgctgaagacgatctctggattttccatcaaaaagagcaataactcatactctcgatgtttgcagtcaacttcgattccatccacgtaaacccgatgcgtttgtgaattgattcggataccgcctaattcgatttcactagatacagtttctgtctgttgtccgcgcttgacccgattgtattgtgcaatgttcgctttgacccgagcgacaagttcggttggcgaaaaaggtttcgaaatataatcatccgcacctatacctaaacctcgcagcttttctaattcttctgacttggccgtgaccataatgattggaatatcgactttatcgcgaatgtttcgacaaatctcatgtccatccattcctggcagcatcacatccaataggatcaattggtatttctccgtcaatgcttcatgatagcccacacaaccgtcgttaacgatatggacttcatacccttccatttctaaaaaatctttttcgatcattgaaatatcttcatcgtcttcaataattaatactcgtacactcaacttcgatcacttcctttttgatttaactgggagggtgataacgatcgctaatccccctgctggatggttgtacgcttgaatcgttccattgaatccttcaatgattttcttcgaaatcgctaagcctaagccattgcctttgctcgggttggttcttgagcggtcatcgcgatagaaaagttcaaacaagtcttccaaattctcttccgaaacaccgctgccgttatcaatgatcgacaagataaactgttcctcaactacttcataagagacgaccacttgtttatcgttgcgatccacatacttgcgggcattttcaaatagatttgttaagactgtacgaaactgaactggatccacttctagcgaaacgttttgatccgtcggttccaatagaatcgtcaatccattcaattcgtattcctgctggataaagccgatgtattcatcgatcagttttttactagtagttgtcactagattgaaaggaaattcaccggtatccaacttagaaaacaagaaaagctgtgcaatcacttggtccaaatcatcgatcttcttttttacaatcgtaaaatatttggtccgcatggcaggtgtattagcgatccccttctctaatccttcgacataggctttgatcgaagtcagtggggttcgcagatcatgggaaatacccgcgatcaattctcgacgattggtttccagtttgttttgattatccatcatttctttcagctgacgtgccataccgttgaagtcttttgagaccggtaaaaattcatcttgcttcgtatactggatctgatattgcagatctccttctctgattttatagaaacctacagtcaataattccaaaggatcggtaatacttcttgtgagatatcgcgtcagaacacggctagtaataaaaataatcgacaaaatcaaaatcacgactaacacgatgatccgagacaacatcgctttgtaatcgcgatcccataatggatcttgataatacaaatcattgtaataatttgaattgatcaagataatcttgtagttgctggtatcaaatgtcgtaagaaaggtttgatcttttaagtaactatgttctccctcttctttaagagcagtttctttcattttttgatctgttacttcccctacagacgaaattagcttgtcgccgcgataaaccagcaatgcaatatttttgctatgattggtctttttgaaatgttgcatgtcggcgactacttctgcatctgtcgtcttctccgtatcccatttgatcaccagactttcaaccgtcgcatactgggcacgaaattcggtattcttgatcatggctccttcatctagcccccagaaataacgccagaccattaaaaaagcaatcactgaagctaataagctcaataaaactgggacaataatcatcaatatatgcgatataaataaacgctgcttgatagtcattcttttcctcttctctttgatagcgatgattcaacatagttatgcagccatcatttaaagtgttctctttgaaaaaattgggatcgcctgttttcacgacgtgatccgcctcttattgaaaggaggtgctgtctatttttttcgattttagcccatacttataggtacttcaaccgatgccttcagtcagttgtgaaagagtgaattctttcttccttgcacacgcaatgatccgatttcttacctttttaaataaagaaaataaaatttgattatcagaataataaaaactgagccaatactatagtaacaggaaatagtaaacaaaaagtaaactattgctaaaaagtaaattaaatacgaaaagtacagcccggcttctccccctaacgcaagactagctgctaattgcggcaactgtatttgttctttgagacagctttcgttatactaaaaaaaaatggaagaaaggacatacactatgacagtcagaattgaagaagtgtcccagtctacttggcgtacaattgctgccttaaaagtatcagaatcccaacatacttttattgaagacaacaccacctccttgctggaagctgcatatgatacttctttgcattgggtcccgcttgctttgtacaaagaagaaaccattgtcggctttgcaatggtcggtgcctataacgaacaagaacaaagtatttggttggatcgcttgatgatcgatcagcattggcaaaaattaggcttaggcaagaaatttatgccgttgctcctagactatcttttctgccattggacagtggaaaaaatctatttaagtgcccacaaagagaacaaaacgatcttttcgttttataccgcttttggctttaggcatacccaccacatagatccagaaaatggtgaactgattatggtatacaagaaaacgactgcgacagaacctttctaaaggttcttcgcagtctttttgcttgtttcaatgaaaatgcgatagtcgggtttcacctgacacttggactaatttgaatctgtctctattctattcgatcagtcactaaaggaatatcgattctattacttttgatttcgtcagggatcctatctgaatcattgcaatttagttaaggagttaagcgatcgtctatccttttttcaattgctgcaaaagctggatgattccacagcagcaaaaatggtttcaaagaattgatagcaaattttagcgggttcggatttatcttgcttttcaaatctaaaaataagaaatggtacccattagtcgcagctcctaatcttcttatctctaaataaagatattccaagtctgctcttcttatgtgaaatagttcctgttcctgctttttcataaacaaacaatggttttcccccaacttgattatgtcaatcgtatcttctccaatgatacatttgcaattaggcgttccagctgaacatttgacaaacccttgaggatattccttggcgtcaatttcaatcagtgctgctacccgctttccatcgagtaacattttttggatgtcatttgaaaatgtactataaaaccatgattgattactcgtttgcttgtccatttacccagctcctccctggcatacttgttcaaaaacgtttgtctataaaaggcgccattctatcattaagagtagtctactattaagaatagtctacttcttacttctcaaacatacaataacattttttattttgaatatatttttttagcttacttattttgagcaatgggcttcgcccaaagtttcttgcaccatcactcgtcttattctcacaaattccacatcatggattcttctcaaactcctattcaatgaatatacaaaagaagcacagaagtaactttctgtgcttcttttggcttgttttgattcctcactttgcacgttctttcgtgacgtttgattcgtcaatcatcagcttttactgactggaatccatagctcgcttttgcagtcgggtttagacaaatcgggactttcatgccacaaaagttcgggtcctccagttaattgataatcagacattgccagccattcgctgtaaatacgcgcccaagtttcttgaactgcttctggaaatggtcctactactgtaaagactgcccaatcagattcttccacttgtaacacatcataaggttctgatgctttttgggtagttgctacaccgacatactgatcaagcgctgttccttccacttctcgttcgacaaaatttgccgacacactgataattcctcgcggctggatatttgccagatttttgagttccataatgcgctctggcgtcagcttttcatacagtgatgtcatttgcggattctctccctgatactgcagcgtgatcctttttttgaaaccgacgatttgaaaaggttcattgtgcacgatccgatagtccattttgttacctcctttgattgtcagctggaaagtcattggtggaaatgcttttagaataacatccagctgttttgcttgtgagggagaaatgccatgcatcccacgaaaggctttgctaaaagcatccgacgaatcatagccaagtaacgttgcagtgtcgattactttcgctccttgtttcaacaagtctcctgccaaaaccaatttcctgcatcgcaaatattcgcttaaagacatacccgccaaataggaaaatacccgccgaaaatgatattccgaacaaccagctaatttagccatgtgtgtaaaatcaatttcttctaacaagttttcttctagataggccattgcctgattcatattctctaaaggattcattcgtcttctctcccatctcctacacaataacaaagttcaaagaacgtcacccggtattatcgttgcatgttttatcggttttagtcaaaagtattttttgatgccccaagtatagcatagaacaagaaattcctttaaatgcatgaacgttctctatgttttaaaaagtgtatttgtaaatagatctatttttttgagctgtcgatgtactgattcctaaagactaccgcacacaaaaataccaaaacaagaagataggctccttgttttggtatttagtcgtttactcatcgatcgttcttaatgaacaatccttgtctccacttaagaatcgacatctcgtaatcaaaaagaactgctaccttttattttcgtctttttattaaatagaatccaataaagctgactaatccaattcctataaggtttaaataactttttgatacgtcattggtttgtggtaattttgcttttgattctgaatctttttgataatttgtattttctttcttagatgttgatgtcttgtttttttgctctgaagtggatgtttttgctggagaagcatcttttgtatatacatatgtgatggtttgcggctctttccctagctttccgatccgattttctggtaattggctctcatctagatgataaccattgatcgacaactgatattctttcgtagtagcatcatagtgatcaccgatatttccttgaatggttttcgctgcatgaatttctttgccgtctttgtcaacatagacaactgtcacagctgccgctctttctgaatctttgcctttatccgaattcttcgtatacacatatgtcacggtttgcgcttgatcactcattactccagtgccattctttggcaactgtttcgtgtctaatgtataaccattgatcgttagtttgtatccatccgtcgtagtcatctccaacatttcctgaaatgacttgtggtgcgtggatctcatttccatctgtgtccacatatttcaccgtcacatctgcggcttttacagggtctttcgcgtacacataggtcactgtttgtgcttgatcactcattaccccaataccattatttggcaactgtttcgtgtctaatgtataaccattgatcgttagtttgtatacatccgtcgtagcgtcgtagtcatctccaacatttcctgtaatgacttgtggtgcgtggatctcatttccatctgtgtccacatattctactgtgacatctgcggctgcttcttgatgattgatcgcaaattgatgcaaataggtacctgaagaaatcgcgtagaagctaaacccatctggttgtgcatatgtcccggctggattattcagacgtgaattgtatttcatcgtatgaataccttcaaattcttctggggttatatcagacacagtgacgtcttgatctgtaatagatagctgagaagaaggaagttgaaccccgtttaagtcaaaatacgtttggctttgactattggatgttgaaaaaggtggaacatagccatcaaaatttgttagtcgattgggcatgatcgaaaacgggacaaaaaatgactgcgttgcagcatcataattcagctccttagcagatatcgtagtcactccatcacttcttcctgtattctgcccataagccgccagattttctaagacaggaaaattgttgataacggtgaaatcgctgaccgcacaaaattgaatccgtaattcctttaaattcggcaatgtagccaatggcgcaatcgtagtaatattcatattcgactcaaaagtaagtgattctaaattcttcatttcaagtatcttcggatagacagcatctgtgacattagcagaagaaaggttcaatcgagtaaaattgtccccaaaatcaggaacattgtcatctgtaacattcgctcccattaaataagcatagactaaactatctatcttagttaataccgaaaaatcagaaatctgattggttccattcatgtaaaaggaagacaggcttgtggcatactccaaaccggacaaatcagcaagagctgaatcagtcgaataaatatagattgtctgcattttactgattttttctttagtgatttctgatacttcgattcctaatgccttcgccactattgactgtaatgtaggatctggtaaccaactagaaacatcctcagtattggcttgattatcaggcaacgaatttgcgaactgttgagcatttgatggcaacaaacttctagctgatttttcctttgatttggcagaacttgtatctggaatcgatgattcttctgtacctactgttgatgctgttgatgttgttgatgcttcactctcagaacttgattcctttgaatcagaagtaacactttcagaggtagaagattcagtaacagtctcaactgaatcgttgctagtttcttgggtggtgtcagactgtacagagtcgtttccctccgctgctagtactgtcactacgggggtagccagtggtgaatttaataagacaaataaagatacatagctaaatatttttcgtttatttttgatctccttttttgctaatcattaccttttctttttttaaccatattctcattttaataataataatcctaaaatggaaaatagtaaagttataacttaactagtgaaatatagcacgaacgttacgcacttttcacaccccaatcacgccatttcatttgctaaaaattaataactactgtatctgtagaccaaagtatttctaggaataatggtagcaaaaaaaatagctgtacctgctttgactttgcttcaaacaaaaatcagtgtatctacgcttactctcccatgactttcaaaaaaggattgcatctaaaattgtaaattgatcagctgaaataaagctgcttcttagcttcctcgtctttcgatattgtggagcaagacaatcaataacagttggcgacaaaaaaagaccagcaaggaatatccccagctggatccacaaatagatattttttacgttttagcagttagatctgttatcgatgccaacagacggaacaaaaaatcccgtttattggtacagtgcagtttttttcttacctgcccattctttggttccattcttctcgcagcacaccgtattttactgagtcataatagtggccttcccaataacgaactctacggatttgtgcttctttcgtcatgcccagtttttccccaaccttcatcatccggtgattgcctgaccaagtcgtatatccgatccgttggatgagtggttcttgttcaaataagaatgtgatccacaaacgcatcgcatgactaccgaccccatgattccatatagtggcatcatagattgctacaccaaattcaagccattgatgcagattgccatcttcccaatatgcagtggcgattcctacaagccttccttgataataaatagccttccgtaatggattatttaaacaatttttgccaaatccatttttgaattcttcccaggttaggatagggtcctgaaaataaggtccatcccactttttccactctaagtcagctttaggaccataactgatcgaccaaagagcagaaaggttttcttcggtgattgatttcaattgtatatgatttttcatctttctccttttcaaacatcaaactgctgaaaaataaaactgaagctacttgtttttaccaaacaaacgttgaaaaaagccatttttttcggacgctgtttctttgactaccactgtaccatcggtgtccttccactttctctgaaacgtaagattatcttgtaaaagtaatccatttaactcgaggataccttttaacccagcaatcgttcggcgcaactcaccgtcttgttgaccatagaaatccttcttcccagcatcttcaagttcttctagttgccggattaactctcgaagtgtttgagcctgatctcccagaatagccgacatctcttccacttgacgttcttctatcgttggtgccgtttcgtaaatagtcactaaagataaactatcgacataatcctttaagtcaaaaagaaacgtttggcttgcttcatcttcaaccattgatgttttcattaaatagttttgtaacgcttccatttgtttttgctgaacgagtaaatctaacactaaggcctctgtgtccatcggtaccacctcctactctattgttgcgtttttcttttgcttcgtcaagaaaagcttcgagaataatgttgaaaaacagacgggctgaatagtaattgttttctctactgtatattacatatcacataccacttcttttatagtcaaatttactagtttctgcaccaccctacagttaactcaattcattgtatctctcaactacaaaaaatatcccctcggcagctaagataccgaggggattggtgcattcattgcttagccgttataagcatccacaatgatttgtttcaattcagaaatcaatggttctttagggttcgcagttgtacattggtcttcgtaagccaattcagccatacgatctacagttgcatccaatacttcttgagtcacgccttgtgctttcaagttcatatcgataccaacggatttacctaattcgtaaaccgcagttgctaatgcttcaactagttccgcagttgtttctcctttaagacctaagaatttcgcaatgtctgcgtaatctgtgtcagcacggaagaaatcatatttagggaacatcgcatgtttttgaggatctttggcattgtaacggataatatgcggtaaaagaatcgcattggtacgtccgtgaggaataccatattctcccccaattttgtgagcaactgagtgacaaatacctaggaatgcattggcgaaggccatacctgccattgttgatgcgttatgcattttttcgcgagattccatatccggtgttttcactgatttttctaagtagtcaaagactaacttgattgcttgtaagctcaacccacgagtgtaatcagatgccattaccgacacataagattcaatcgcatgggtcaatacatccatacctgtatctgctgttacagaagcaggaactgacatgacgaattgagggtcaacgatcgctacatctggtgttaatgcgtagtctgctaatgggtatttcacatgcgtatcgctatctgtgataaccgcaaatggggttacttcagaacctgtaccggaagttgttgggatacatacaaattgagttttttctggtttgtcgatcttgtatgtccgtttacggatatccaagaatttttgttttgcgccaaagaaagatgtatctgggtgttcatagaacatccacatgcctttcgcagcatccattgctgatccaccaccaagagcgattactgtatctggtttgaaatcaaccatcatcttcgttccagcataaacggtatttgttgatgggtttggttctacatctgagaagacttcgatcttcacatcgtttttgcggcgagcaagaacttcgcgaacggtatcgcagtagccgaattgaaccattcctgggtcacaaacgatcatgacacgttcaacattttccattttctctaagtataatagagagttcttttcaaagaagatttttggcggtaatttaaaccattgcatattatttctccgtttcgctacagttttaacgttgatcaagttcacagcagaaacattacgagaaacagagttctttccgtatgaaccacaaccaagtgtcaatgaagggatcatttcattgtagatattaccgataccaccttcagcagatggagtattcaccaagatacggcaagctttcatgcgtaagccaaatgccaattgcaaatcttcattttctgtgtggataaccgctgtatgtcctaatccacctaaaccaagcatagcttcacatttttggaaagcatcttctgtgttgtttgctttgatcattgctagaactggagaaagtttttcgcgagataatgggtaatctgcacccacgccatctagttctgcaatcaatagtttcgtaccttcaggcaccttgatgcctgctaattttgcgatctccattgctgaatgtccaacaattgctggatttacagcatatttgccttcattcatcactgcatcttcaagtttttgcaattcttttggttttaccacgtatacttgatgagcttcaaactctgctttaacagctgcatagacttctttatcaacgatcactgcttgttcagaagcacagatcattccgttatcaaatgttttagaaacgatcaaatcgttgaccgcgcgtttgatttttgctgttttttcgatgtaagaagggacgttacctggacctacacctagggctggttttcctgttgagtatgcagctttgaccatgcctgcaccaccagttgccaatacgatggcgattcctgggtgattcatcaataagcctgttgcttcgattgatggatgttcgatccattgcacacagttttctggtgcaccggctgcgattgctgcatcacgaacgatccgcgctgcttctgctgaacatttttgagcagatggatggaaagcaaacacgattgggttccgagtcttcaatgcgatcattgctttaaagatcgttgttgacgttgggttcgttgttggagttaccccacagacaaccccgactggttcagcaatttcgatcaaccctttttgtttgtcttcattgatcacgccaactgttttgtcatgtttgatgctattccaaatatattctgaagcatacatatttttgattgctttatcttcatagattccgcgacccgtttcttcaactgccatttttgcaagcggcatatgtttgtctaaggctgccatagccatttcgtgtacgatatggtctactttctcttgatcaaagttttccatttcttttaaggccacgtttgctttttttgcaagatcatcgatcattgcttgtacatcgatcgtcacttctttttccaatgtcttagccattgtaatcctcctagttcgttaacaatttatttgttaattacttcacatatacatcatacaataactcttttcgtttgtaaacaatttctgtgatttttttcacagttttttaaaaataagttaaatcaagcgttttcaacatatcgagttattttaatctgatgtttaagtgactcgagtatccatgtgctttattgaacaatcgttgcttttatcaagctttttccaagaaaaagaaccgatatatttgattgattctcaaatatatcggttcttagtatgatggatactgattttggttttgcatttacatagatgaacaataacactctattgtccaattttgaaggagcgtgtttcttcagaggtgatttttttcaaaaattcactcaatagaatgattgtttgcaaataatcttctttgtggatgattaatcttgaggaatgcatataccttgtcggaatcgatactgtcattgcaacaactcctgtcattgctttatggatgttgcaagcatctgtccctccaacagtcatgaagtcatgccgataaggtagtttttgtcttactgcaatctcttccatttttgcaagcagttcactattaccgatcgttagcgaatccaaaacagagagtacaggaccttttcccagttgcaatcccccttgatcaaagggagtgtctacagcggtagtgacatctaacgcaatcgccaaatcgggcttaatgctgtgggcagctgtacgggcacctcgtataccgacttcttcttgagtcgttgccgcaaagtagacatcaacagctagctcttctttggctaaagcgttcatgacctcaatacagacacccacacaaactcgatcatcccacgctttccctagcaagtaattcggatcattcatttcacgaaagaccgtcttaggtgtaaccatgtcgcctaccattattcataactggcgaatatattcagctgacggaacccccatatctaaataaaattcattagctgggatcactttattcttttcttctggcggcatcccgtggggcacgcgacttccaatgacccctgtgtatttcttgccttccatcgttgtgacacgcatttcctgtgcgggcatgacgtgtccccaccagccgcctaccggtaagagtttcaaataaccttccttggtgatttttcgaactacgaaaccgacttcgtccatgtgggctgataacatcactttgggcgcattcgctttagaactcttttttactaagatcaatgaaccaaggttgtcataaaaacagaaatcaactgctccttctgcatatttcttcacgattctggatatttctttttcccggccgccgataccatcggcttcacttaattcttttaggatttctaagtctacagctctcatagggatcgtctcctagcggttttcttctttgaatgaaacaatcgctgcttcgtctaagtctttcagaaaaagatagatggcttgaccgactgtttcataatcttcttgcgaaacaacttgagctgctgtgttcatatttcttacaggcatgttcataaataagactggacatcccgtccgtaatttgttgaaccaagcaccgtctgagtcttctaatgagaaataatattgatatggcaatgctgcctcttcacagatttttctcaattcttccatcggcaaccgatttggcaaaacggaaggatcataatatgtcaatagaactccttttgagagttctccttgtacatcgccagcatcttcctgataatcccaggctcgatttgtatctaggatgatcgttaggtctggtgcaaccagattcgctgctgtttgagcacctctggcaccgacttgctcctgaaccgtacatccaacatatagatcaaaagggaagctgagttgattttcataaatttgacgtaacaaatcaatcgtttgattgacagaaatccgtccattccaatttggagcgatccattcttttccatttttgctgacagtaaatttgggcgcaaatgtcaccatatctcccaaagaaacttcttctgacaatgcttcctcttttgaagaaaaaccaaaatctaataaaacgtcctcttttccctgaacctggtttgctttgtttcgtcctaaaatgacgcctgggaaggctttcccttgtcgattgtacaggtggacttcctgtcccaataagctattcggctcgattttccccattatcagtccgcgaatcaagccggtttcttcgatttttttgacaataaacccaagttcatccatatgggcagtcactaaaacagtggttggattctccttttcagatttgatgaccccatagatcgaacctagattgtcatagatgatttcatcgcagtaaggtgcataatactctttcaataatttagagattgttttttctcttccggaaattccgggagttttgaccactttttcgagctgatccatttgtcccatctgctttaccactccttagtaacaatgttccttcacgtaatccgttgtatcttttttctctgctttcaactgacaaagagtcaacatttcgttcattgcttctgttaatccagtaccacccttttttggcatttttacaatatctacttgatctttaaatcttgtgattgcctcttggcattcaatggacatcgccgcaacagcagggatctgaaccttctcttcgacaactttcgcaacttcagcagccatttccccgtatgtttcataattaaaacatggaccgcaaagcaacacatctgcgcctaatttctgtaccattgcggcaatctttaaagaagattccttcgcatgctttcggtaatagtcatcaccacaataaatcgtggcaagaacctccatattcttttcctttaataacttttcgaacattttgacagaaccaatcgctgtcttttgcccccctaatggctgatccccatgttctttcccaccaagtccggcttgaatttgatccagcaaaaagattattttcattgtgatcccccttctataacaagtgatcgatggaaatatcatcaaacgacaattccagttcttcacttttggcttgttctgcttcccgttcatccttcaggtattgcttgtctaatgccataatgaatggatagtagatcaaacaaccaatggctaatagaatcaattgccagacagaggcaaccagacttcctgtactcaaataccctgagaagccgatcggggtcgtccatggcaatgaaacgccggttgtataaggaatgattcctaggttggttaccaatgttgataaaagcagattaaccattggaacagcgataaaaggaataataatgattggattcaatacgactggcaaaccaaagatgattggctcattgatcccgaaaattccaggaacgagcgaaagtttccctagttctttgatccgttttgatttacagaagaggaccatgatgattacaagggaaagtgtagaaccaccgccgccaaagttggtaaagaagttcgaaaatggatccgtgaagatgtttggcaaatctttaccagcttgaaaggcatctaggttttccatggttagaattcttaagatcggcgcaaatacagaattggctaccgccggaccattaatcccaaagaaccaaaaaatcgtacaggctaaactatagaaaatctgtgcggttaatgtattaccggctccttttaatggcatttgcaagacattaaagataaaatcatggacggtaccaaaaggggtcataccaaataatatattgatgacaaaaaataagagcatgactagtgcacttggaatcagcgcagcaaaggatttcgttacagcaggtggaaccccatcaggcatcttgatggtccagcctcgttttgttgtataagcataaatttctacagaaataagtgcgacgagcaaaccgacaaaaatcccatttgttcctaagtgatcaaaagaaagcccgctaattggatctgccactccttcaacgatcagcttatttggtgttaaaatcaaaaacgcaatcacggctaccgctgccgcttggatgggatcggttttcttttcccgtccataagcatacgccgttcctagacatgaaaagaagccaactgtattaaagacagaaccagaaacccgagtgacccacgactcccaacctgtaccaaacattcctgcccaaaactctgaccaccctggtattggaaaatttgcgaacagtaagaaaatcgatcctacaatcactaatggtgtcgtgatcaaaaagccatcacgcactgcgatcaaaattttgttctgccctaactttaccgcaagcggcatcaacacattttctaatttatcgaacattccactcttcctttcgagatcttgctctttgcaatcctctttttttgaaatcataccggtgctttgatgcgtgcttcatatgcatcaagccactcttgcgtgatcggtgtgatcaccgtggtttgatctggaccaggattggccatataaatagccgcttcttggtcagctgtcgcaacgctaaatgtgaattctacatttgttgccaccccccatgccccatttttatccaatgctatcaacgaaaaggcacctgctttgccataacgtttgcgtaatcgttcttcaaacccataaacagcccggtcacaagcggcttgtggtgaaagaccttctcccatcaagcggacgatttcataagaaagacagcctttcatcaaatcttcacccaaacctgtagcggcagctccgccaatcgtactgtctacataaaatcctgagccggataatggcgaatctcccactcgaccctgttttttcatgaacaaaccagagctagaggttccgactgccatttgctgttgcgtatcgagagcaacaacgccaaccgtgtcatggccatcgtaaggatcgaggttggaagcagcgatttctgctaatcgtttttcccagattttttttgcccgatcggtcaacatattcttacgttcaaatccagccaacatcgcgtattcggtggctccttgccctactcgaaagctattgaatttctcatcactcaattggcgtgcaactgagatgggattggcaacatcggtaatccctgcaacggcaccaatcttaaatgtttcaccatccataaaagcggcatccatttcgacgattccgcgttcatttggcaatccgccataaccaactgatttataaaatggataatcttccactgctttgatggcagtttctactgcatctttgcatgacgcttgtccttctaaaagttctttggctgccagtacaccatcgtgtgccattcgccaagttgcaatcattccccacatatctttccctccatcatttgtagcgcttacaagtatattctatatggtatatactagtatgtctatactaaaaaacgagtttctttcaactatcattgatttataagaaactcgtttcggattttttttattgttgaggattcatccagggcattcttattctgttaatgctttgatgctgcgcatgtagatctctaaattcatccgtaagtcagcactgtccatgtactcattcttattgtgtgcaatccctttttgaccaggaaaagacggaccaaatgccaagatattcggcattttgcgtgcataggttgcccctgttgtggttactggtttagggtcattgcctgtgactgtgtgataaatcgtcgacagtttagctatttcggttgattctttgtctcggcaaaacccgggaatactgcgaatgacttctaattcgacaccgataggcagttgccttttcaaacgggacaatacgtctgtttctgtaacagtcgctgggtagcgaaaggcaacttccatcactaatcctgtgagagacttttgtatcacgacaggcgtcaaaatcaatttaccagaatcttcatcagccagcgccaagtcaatcccttctccaaaatgctgctgatgaaagctttgacagatccaacgaaaataagattgtatggttggaggaatagtttgtttctcagccagttgggctgccaggatcgaaattgcattttctcccaattcaggagcattgcttggagaacgtttccctgtgacttcaaacttctgatcggcaatgcttacactcaagtcgtcaggaacatggtctcggaattgatccccctgaaacgaagtgagttgctgtagttcatcgtctggcagcggaaaatggagcgctacattgacgacccctcgttcgccatagactaccggatacttacaatctggcgtaaatccgaacacaggtggttgttctgcggccaaataatgaggaacatccgacataccactttcttcatccgtaccgaaaatgatccgcagattttttttcggttggtgtcctaattctttcaataatttcatcccataaaggcaactaatgattggtcctttgttgtctagaattccccgaccataaaggcggccgtctttttcgcttaaatcaaacggcggaaaatcccagtctgaacccgcaggcaccacatcgagatgtcccaggataccgatgtagtctgacccttctggtccccactgtgcatagccgatcgcatcatcgatcacctttgttccaaatccaaaagcggcacttttttccattaccaaagacaaaactcgccgagtttccgtaccatagggcgcctgtggcataggttcagatttgacactaggaacttgcatgacttgtttgagtaagtttagaaaatccagccagttttcctcaatggctgtgctgatttggtccatttttgccaccccttatttttgacgtaccaatgtatttttaaaggtatatttatctgcacgataaaaagatgtatcgaacaagatcggtttcgcagaaggggaataagtcatcgaatggacgagaagcattggttcctcttcggatacatgcaatagcttggcaatgtctggcggacttttgaccgcttccacttcttgatgggaataaccaatctcaatgttggcttcgatcacttcatataaagaagactctaactgatctttggtgatttcgccggactctttttctaaataacgcttcaatacatagaggttctccaccgtcatcggttcatcatcaaaataacgcaaacgagtcagatacaccattggttctttcccatagttgccgaacatctgtcggatcttagtcggtaattctttcactgtctctacttgtaatacttcggttcgggtctttttcccttgggctttggccgtttcggtgaagctttgcaatccgccagatccactctggatctttggctgcttcatcacatacgttcctttgcctttttctttgactaggatattttgggtgatcagaagatcgatggctttgcggacagttagccgactgcattgaaattcttccgctaaatcataatcagaaggcagcttctgactcgttacataagtgccatcattgacacgttgggcgattttatctgctacttcctgaaaaacggcttgttttttcacttgattccctactttctactctaccattcataaaatggacgattcgcactcacaccagaagccacactaacaaaggcctggttgtcgacggattgaatcattccttcaactgtctttaattcttttcgggagatgactaaaagcaacaatttcttctgttgatgatcaaagcccccctcaacatcattgatcactgtgatccctcgctgaagtgcacattgtaatgttgcaatgacaccttctgctttttcggttactactagtaattgcacacgcctttgcttgagattcacgtagtctaccattcgaccactgataaagaaagagattgcactataaaaagcgtacggccagccaaaaatcattccagcaacgagttggagactgacattgaaaaagataaagaaactgccaatacttttgccggtcattctcttcactaagatccctaaaatatctaatcctcctgtggaaaaatcatcgtttaaagtcagaccaacggaaaacccatggagcacaccgccaaaaacagcgcagatgactggatctgtagtcaatgtgacaactgggaccaccttcatcataacagatgagaggaagacagtacaaaccgtcataagcgcgaaatcacgatcgattttgcaccatgcaatcgctaacaatggcgcgttaaaaaataagaccaacacagggattgaccactcgttaccaaagtatacttccaagagctgcgacaataattgtgaaagtccagtaattccactggcaaatatatttcctggcagccagaacatattcaatgcgatggatgataacagtgcataaatgagtgcaacagctaatcgttttattctttttggcataagcatctccttccgcttcgattatagtatatatcattaagtatatactgtcatcaaaaaacttattttctttaaagaaaccgcctttgctgatccatagtctttctcaggatcgaggggtaaaatttatcctgacatgcgggctagaaaaagagagtaaaatacttgaaaaatgactaattttgactaaaataataattggaaagaaaaataaagaaaggattgattattatgtcacatgagattgaacctcgtcgctcagatgcctatagtatgacaccttttaatttcttcgaagattttggtcgcagtttttttgatggttttaaagcgaacatgatcaaaacagatattcacgaaaatgattcggaatatctcgttgaagcagagctgcctggtattcctaaagaaaatattcaagtcacttatgagaatggtattttgacgattgctggtcaacatcaatcggatactacgactgaagataaaaaaggaaaactagtacgcagcgagcgtagtttaacaagtgttcgtcgccaatatttgctagaaaatgtcaaagaagacgacatcaaagcttcttattctgaaggtattcttaaattgactttgccaaaagatgatcacggcaaagaacctaagaaaaccattccgatcgagtagcagcatcacttttaccaaacaaacagcccccttaacagaaatgcttgttaagggggctattaatgtagaaaaagacctgttctccatgctttgcttgctgatttttttgctcttgctaaagaacaagcgaaaatctggacaaacgccactctataaaaaaagaggctgggacagaggtgctaaactcctagaaataagaaggaatacgcggaaattgcttctcaaattttggggtatttcgacttgtttccgaaggagttgcttctgctcccaccatctagacgtgtttagagcgtgggacaaaagttttttttacttttgtcccacgctctagtcctagctgtctttgtcagacggatcgaaaaaattattcttttgtatcgtctgcttttgtttcatcaacaacatcagctggttcgatttcagttgcaacagatgcaccagtaccaggtgtcacggtacgaatcgctgcccgatcgaactctaagaaaataccttcacagtcgatgacaactgtactcttgtctgtatttacttcagaaagaacgccatgaagtccgccaattgttactacgcgatctccagccttcatattttccaataagttttttcgttcttgctgttgtttcttttgtgaacggctcatgaagaaccacattgccaccaaagcaacaagcataaagagcattggtaaagattgtgccatttttttcacctcgatttttttacttttctatagatactttatcagaatctgacgtgtattcctaccgttttaccagaataaattagaaatttttggcattttctttattgaagccatattcttcgaagaaatgttgccggaattccagcaagttgtcatccatgatcgcttgacggacttgtttcatcaaattcaacaagaaataaacattgtgataagaagttaatcggatcccgaatgtttcatcacatttgatcaaatgacgaatatacgcccgtgagtaattcttacaagtataacaatcacagttttcatcaattggtcggaaatctcgggcaaactgggcattcttcacgactaaacgacctttagacgtcatacatgttccgttacgggcgattcgagtcggtaatacgcagtcaaacatatcgaccccgcgaataacgccgtcgatcagagaatctgcggctcctacccccatcagatagcgaggtttgtggtcagggatccatggtgtggtaaattccaagacgcgattcatttcagcttttggctcgcctactgacaaaccgccaatcgaataaccaggaaagtccatgctgatcaaatcttgcgcactttgtttccgtaaatcttcaaaaccggccccttgaatgatcccgaacaggccttgagaatctggattggcatgagctttcaatccgcgttctgcccagcgagaagtccgttctactgattttttgacatactcatagctttcatcgaatggcggacattcatcaaaactcatcatgatatccgaacctagtttgttttggatatcgatagctttttctggtgaaaggaacatttttgaaccgtttagatggttcttgaaatggacaccttcttcaacaatatttcgcatatctgctagtgagaaaacttggaagccaccagaatcggttagaatcggctgatcccaattcataaacttatgcagcccacctgcttcggccactagatcttctcctggtcgcagccataagtgatatgtattacttaaaatgacaccagcgcccatggctttcagttcttccggtgcaagggtcttaacagtagctaaagttcctacaggcataaacattggcgttggaaaagtgccatgcggtgtgatcaattcacctaaacgggcacctgtatgtttctctttcttgatcagacgataacgaatggcaggttgcgacattcatttccctactttctttatagactcgattaactgtgcaacgctattaatgataagggttgcgttaggaatttgcaagaaggtttcagcttctcttcctctttttcaaaaaaactttcctttctttgctttattttttgtacaatccatgctcatttgctatcatgttaaacagatagaaaggaggtttttttatgaaaactagaggacaactaaaaagtgaagccaaatccgttctgaatggacgctggaaagatagcgtattgatgtgcttggtccctacgttgatctctattgcttttgctgttgtgatcgtagtgattgttgtgttgcctttgatggcattaagtcaaaatggtgcctttgatagtcaatccatcaatgaagcgtcgaactcaactggcggtagtggcggtggcttgatcagcggattattctcagcattgtttggtgccgggatttcttggacattccttgatttgttacgcggcaataaacaagagattcgtccattttctgatgtctttcgtggatttagcggtgtattcgcacttggtatcattgtcatctatattttatcaacgattttcgttagtttatgggcattattatttgtgattccaggaatcatcaaatcctattcctactcacaagcatacttcatctactatgatacctatgagcaaacaggtacacggccagattttcttgcttgcatcacggctagccgccgattgatgaaagggtataaaggaaaactgttcttacttgatttgagttttattggctggcacattctagccattatcacagctggtatcgggtatctttggttgacaccttatatcagtgctaccaaagcagccttttatgaaaacttgccaaaacagacattagcttaaaaaaaggaccttactttgacatatcaaagtaaggtcctttttgattgaatgaaaaattgttctcaacgtaatgtttcttccgttaattgacacgttttgcttccacagcatctttgactgaattcgcaacgattttggctactccttcttggaaagcatccggaataatgtttgttggtgacagctcctcgtctggaatcaagctagcaattccttttgctgcggcaatctgcatctcaaccgtgattttgcgggcttgagcatctaaagctccacggaaaataccaggaaaagccaacacattgttgatttgattgggaaaatcactgcgtccagtaccaatgatataggcacctcctgctaaggcttcgtctgggaagatttccggtactggattagccatagcaaaaatcacaggcttatctcccatctcagcgatccattccttcttcagtgctcctggagcagaaacaccaatgaagatatcagcacctttcaacgctgtctgcaaatcaccagaaagatggtcacggtttgtcactttagcaatctctgcgtgatgaggtggtaactgatcattttcttcattcaagatccccaccttgtctacgacaatgacattttttgcaccagctgccaaaaacttacgagtaatagaaagtccagcagaaccaccgccattgacaacgattttggcttctgctagtgatttgccaatcaatttcaggctgttgaaagcagccgctaagacaactattgccgtcccatgctggtcatcgtggaaaatcgggatcgcacactcttcgatcagccgctgttcgatttcgaagcaacgcggcgcactgatatcttctaagttgattccaccaaaggtcggtgcaattgctttgacgatcgcaataatctcttctgtctcttgagtatctaaaacgataggaatagcatctacatctgcaaatcgcttgaacaaagcggctttcccttccatgaccggcattgctgcttctgctccaatattaccaagacctaacacagcagaaccatcgcttacaacagcgactgtgtttttctttgttgtcaatgaataggccagctgtttatcttctgcaatcgcggaagatacggcagcgacacccggagtgtaggcaatgcttaagtctcttcgattttcaatcgccgcttttgatactacttccaatttaccgccatgttctttggcttgtcgcaaagcgatttcttttacatcttctgacatgattcgttcctccaatagttgatcgttttttctattttttattaaaaaatcattcgcaagattgcggtcatggcaatcactgtgatggcgccgcctaaacgggtagctacttgggcaaaaggcatcaagttcatacggtcagcggtacttaagatcgctacgtctcctgtgcctcccataccgctttgacaagcagaaataattgcggcttcgatgggatacatgttcatgaaacgtgatacgacgaacccggtggcaattaccgtgaacactacactgatgacgactaagaaataagagacactcagtgttcccacaacgtctttcaatggaatatacaacaatcctaaaccagccatcaatgggaaagtaaagttgccggaaataaatttatacaattgtttggagccatgttgtgtttctgccggcaccacattcaagtatttcaaaaaagcggctaagacaatcatcaatacaggaccaggaaacccagtcaaatgctgcagtaaactaccagcaatgaacagtgtacaagcggtcagcacaccagcgcccattttcttgatatcaaaagcgccggaatcatcttttaacgcatctgccatgtcatcatcatttttcattttgaccaattgtccacccccagaaagatctggtcgtttttctccccagcgagagagcaatgcggtacacatgatcgcgaagaaattaccaatgatcgttgctggaatcagttgtgcgaccagctgttcactccccataccagtaatggcactgtagcctagtgataaaggcaagattccttcaccgatcccgccagctaacactggagtaacgatgaaaaacaacgtatgttgccattctaaacctaataatacaccaactagcgtaccaacacccatggcgcagatcatcccaatcatcatgggaataatcatccgcatcaaaccttggactaagattttgcgattcatccctaaaatactgccgcaaactaaacaagcaatataaaaatataagaagttggcttgcttcatcaaaatatcggcagactcaagaatattcggattgactaagttgaagaaaaccaaaatagatggaaccaataaagataaaattgccggaccaccgaaattcttgataaaaggaatagtggcaccaatcgttcctaataaccaccctaaagtcaaaatgaccgcaaaaccacctagcatatttacgggtaattgttgtaacagacccgtgactacgatgactgttgataaaacaatgtatactggcagcggaactgatccaattttgattttcatccaccgatcaattagcttctcttcttttgctttagattcaacctgttctctcgccacatggggttcgatatgcttttccattttgctttcctcctaaattgatctactagttctacgagtacctcgttacacacagattaaagcaagcgttttctttttcgtagtttatttaattattttaagtatttaaattaattaaagcgtctttagggattccgccgctatgttataatttacgaataaagggggaaatgtagtgaaaaaagggttacggttatggggggtattgactttagtctttacaatcgtcttactcattgtcacttccattctttatggtttagtccttattcaaaattccacatttattcgctccaacgaagaacacctgctcttgtccgtcggtaaacagctggcgatcgatccacaagtgactaccgctttggaagaaggacgttccaacgatcaattggaagcttacacaaatgaagtgacacacatacacgggttggatttcgtggtagttatggatatgcaagccattcgtttgactcatccagatgagacccaaatcggcaaacacttcgaaggcggtgatgaagtcactgcattggaaggaaaagaacatgtttctgtcagtgaaggaacattgggtcgctcgttgcggggattcgttcccgtctattccctcactgaatcgcaaaaacaaatcggtgtagtagctttagggatccgtatgcagtccttgagtgctttagtaaagagttctcgggaagggtatctacttgccttagcattaagtatcacaatcgccgcctttgcagcaactggacttgcctattatttgaaacggcaacttcataatttagaaccaaaagaaatctcacgtctctttgaagaacgcaatgccatgttggaagaaactaaagatgcggtcattgtattggatttgaaccaacaaatcaatttggcaaatatcgccgccaacgagctttaccaaaagaacagtggacacaatgactccttggtcggcaaacatttgcaggatttgatcttgcagaccgatgctgtagacttggagcgaaatgttgaacagctctatcggcaaaatggacaggattttcttttttcctctgcaccgatcaatgtggatcagaaacggatcggttggatcgtgtttttgcgcaatgcgacagaatcgttattcgtcatggatcagttagccaatactactgcttacgccagtgcgctgcagtctcagtcccatgagtttatgaataaactgcatgtgatctatgggctcgctgatttaaaagcctatgatgaattgaaaatttatctggatgatattttgactccagaaaaagagttctctcatcgcttgtcttttttagttcagaatccgcaagttgctggatttttgattggcgaacgtcaaaagttctttgagcgtaaaatccacttgatgatcgagatttcaccagaaattcccgccaattcgcaagaagttgaaacaaaatcgttgatcgatctttaccggtatattcatcatgttttgttgcaactaaacaccatagaagatttgcggatcgagatccatcatgaaacaggcctgctgacaacgacctataccattcagctgaccacaacggatcagcagcaattgcaggatagttttcacagcaactatttccaacaaatgttaaaagattaccaggcagagtttttgatagaagaacaacctaactttgtcgttctccaattacaaacgcattatcatggggtgataaaatgaaaccattacatggattaattgtcgaagatgacccaatggtggaatttatccatcggaattatttagaaaaaatcggcagatttcaagaaatctattcggcagatgctgtgacagatgctgaatacttactacaaaacaaacaagttgatttagtgctgctagatgtccatttgaaaaatggcaacggcttagacttgctcaaagagatccggaactctcagcaagccatcgaagtgatcttgatcacagcagccaatgagacacaaactattcagcatggactacatttaggtgttctggactatctcgtcaagccctttacctatgaacgtttccggcaaagcatcgaactatttctaaaacggcaagaagctttggaacaagacagtcttgcccaagaaaccattgatcaaataatggttgcaaagaagagtcccgagtcatcccttacagaactggataaaggactctctcctgataccatggatcgcatcaaagcggctatccaaacatttccagacactttcacgatcccagacttggtagagatcagcggattttctcatgtctcagtccgtaaatacatgctttacttagaaaaaaataactatgttaccagtcagattatctataccaaaatcggacgcccttataaagtttaccaacgatcctaacaattagtggactctctctaggaacgtcaacgagtgattgctgatttgctgattattgaataaacgatgttttagtaagtcagctttttagattttaaattgtgaattgatcgttgtactttgtataccctatctatttgcaaacgcttcctaaatatgctatagtataggtgtaaggaaggtagcaactctgttggtggtcttgtaaatatcgcaaactcaatctactaaaagttgttgaacgtacaagtttcacctagtatcaagcgtgtaaagtaacagaaaagcgtaacacaaaatcgagaatcttttcgaaaaaaggatacgtctattacgttgtatcagtacacacgaaacatgtgtaagtttgtaaaagaaaacaaattttgagaaacaattgctttgcatgaaccaaccatcagcgaccaccacttataccttcccttagttataagctggacgacaaaaaagcagttcaaaaagttgagaagtatcccaacttaacgagccgctcttgtcgttcagttttttattttaagaacatggcatcgccaaaactaaagaagcgataacgttcatcgatggcatgctgataagcttctaatgttagatcgcgtccggcaaaggcactgaccaacattaccaatgtcgatttcggtaaatggaaattcgttgagaaggcttggacaactttgaactgatagccgggggtaatgaaaatactcgtccagccgctgtcggctttgatatcgccatcaaatttggtaccaatcgtctctaatgtacggatcgaagtcgttccgaccgcaacgattttcccaccatttgcccgcacatcgtttaattgagccgccgcttcttccgtcaatcgataaaattcactgtgcatttcgtgatccgcaatattatcgacgctaactgggcggaaagttcctagacccacgtgtaaggtcaaataaactaatttgacccctttatcagcgattttcttcaataattctggcgtaaagtgcaaaccggccgttggtgccgctgcagatccattctctttagcataaacggtttggtaacgatctggatcttccaatcgttccttgatgtatggcggcaatggcatttcacccaaagattctaaaatctctaagaaaatcccatcatagctgaatcgaataattcggccaccatgttcgagttctttttcaacgaccgcttctaagcgaccgtcgccaaaggtgatcttcgtaccgacttttgctcgcttggcaggtttgattaatgtttcccaactgtccccttcgatattgtttaacaataaaatctctagatgagcgccggtctcgattttctcgccatagatacgagcgggcaaaacgcgagtatcattcatcacaagggcatcgccaggagctaattcatcaataatgtcataaaaatgtttgtcttccattgcaccgctttctcggtccacgaccaataggcgggaactggagcgatcgctaagcggcgtttgagcgatcaattcttccggtaactcaaagtcaaaatcttctgttgtaagcatgtcgtcactctctttctttcatatgcccgtctattctatcatgtttagagattactcgccaattaggaaactaggcatagctttaaataaaaagagcgctagagagagactagaaccttttcacggtgctcctaatctattagagaattttaaccgataacacggaatcttctgccttttttatctgctttatcgttttgtgaataaaacaaaattttttcacgtgggattttttcttgctgagcacattttttcaatgtgtcataaacataactgctgttgtttttataaaaaaccatgacttttttcgagtcaatttctttgcgatagtcttcatatttctttcttaatcgttcaacttctgtaacaatctctgaatctttattccaatcgggaattgcagtaagcaagcaaattcgtttccagtattctttttccattattcaaactaaccacgaaagacatttaggttgaactgctaacctatgctttacgaatcacttcgtctctatcgattcacttctatcgaaaattcataaagccatcctttcattcctttcttaatcgctccaaggagaactatattcaaaaaatgctacttgttccattacttgtcctattcaacactgggataattaagaataatacgataattatcaataaccgctttgatgttttggccgtcagcaaaagatacttcaaatagtggactatctttttttattgaggaaatttcaatgtttagatacttaaaatatgcccctaaaattttctcaggatctatctcttgaaatgattgctctgggtaatatttaaattggacgattttattagtcgattcctcaatcagggcttccccataaccttcgatcgaagaataattgatttgccaataaacagtttccgaatcaatctttagattctgggataacgtaaccaagtattctgaagagattcccatttcttttagcagcttctctatttccaccgcatatgtattgacatactggcttccttctcccgtattattatattgcgttactttcccggcgttcgtgagcacttcttctaatgtacttttatttgaaggcagctccaaggattcttcaaatacgactggctttgacaatgaatctgtaaacagcatatttggtaaaaatagtagaaatacgttgaaaccgacccataggaggatcagacttatctttattcttttcctcatcttcagtcctcatctaaaggaaagtcgatcgtaataaacgttccttcacctttctcactagtgatcgtcacttgcccttcatgaagtgagataatattcttcactaatgaaagccctaagcctaaatgcccagaatttctagtgacatcccccgtaaaaaattcatcagtgacttgatcaataatctcttcgggaattccctgaccagtatctttcagtataaaataatatcgtccttcattactgtagccagtgatgcacatctctttcctatccttcatcgcatctaatgcgttagaaaatatatttgcaatgactaatttaaataggttaaagtccattcgtatggtggccttttgaagagtcatctgcaaaaggatccgctcatctaatccagagacaaattgagtaatataagagtcaatctggtctgtcgatattgcttcgagattcatttcatttttcttcgagtacaataaacgcaaaacatcttctgataggcttttcaagcggaaactttcttctaaaatataatcgacaaattccgaagaaggttcctttagatcctcccactgcaacatttgcgcatagccgatgatcgacgttagcggggtagaaatttcatgggataaacttgagacaaataattcttgcttttctttttcctgactgatttgttctatgtcttgatttaatttattggccatgtcgtttaggctgttggcaagcttttcaacttcatctccacgtttttcaacaacgaaaggctttgttgtttgcccttttgcaatctctgttgcgcgatcaatcaatttttgaatcggtttagtgatgagggttgataaaaaccacgacattggaatcaaaacgatctgcaaaagaaataaaatcattcgaaaataatgacttgctttcttcagaatactttgataagtgattagattctgcttagacaccaaataatagtctgtcgttccaattgtcgagcttgtaaataaaaacttctcttgtttgattgtgatgattgggctaatgttgattgtgttcttcttaattgaatcgtaatcaacaacctctgttatgcttggaaagtcagttgtactggcatacacactctttccttctttatccaaaatttcaaaatcattctttaccgtgctcttgactatatcacttagattccgtaactgctctttcgtaggttcttgatcttcaattttggctgcaaatagtatcgcagcacttttttgggtagctagtgcttgatcatattcctgattgattgcatgttgagcgatgatccgcaaactgatggtgctgatccctaaatacaaaagtaaaaaaaagaatagcagccaatagaatgcttttgtcgcatatttcatcttattcctccaataagtaccctacaccataaatcgttcgcagctcgttttccaaatgcagtttctttctgatccgctgaatgtgtaaatcaagagttctgctatctggctcacttggcgattcccaaattcgttgataaatcgtttctcgctctaaaataattccgcgattttgaacgagataaatgaacaattgatattctttaggcgtcaatgcaatcaactcattgttaaaaaatacacttctcttctcgtcttcaatacggatgttgtgccaatttatctcagaaacagaactctttttccttctgcgaagtactgtttcaactcgagcaaataattcttctagttcaaaaggtttcgtaatgtaatcttctgcacctaactttaatcctcgcactttatcatgcaaggtattcttggcagttaaaaagataactgggatatcaaattcgacaaaatagtctattaattcatccccacttatttctggtaacatgatatctaaaagaatcagatccacctcatgattttcaatgtaatctgcggcacttttgccatcaaaaatcgggatcgttcgatagcctttttttgcgaggctttttactagcaggttatttatggcttgattgtcttctactatgagtacatccatttgatttcacactttcttcccaatttttgtaaagaagctgttttataagctgatagccgatcatgataccgcacaaaaaaagatagagcaaaagtaaaagtacgatcgatcgattgtcaatatcttcaaaatcagcgaaaattttttgaagcgcttgattgtgacgcacaaaaatatctgtactattaagacgggtaaatcgcccaatataaatcccaatagaatccataaataaaagacacgcaatcaaaagcgctgggtagacaccaatggttaatttctctactaatattcttgcaatcttgtcaatgctccagcagcccaaaattgttgaaggcatcactgccaacaaaatcagaaaaagtttgatccaattcattaaatccttacttatcaacaatgttacttcatcataaggtgtcaataaagaaagatgaaatagatctgtcatgagataaaaattatttggtaaaaaaacaagccagagacacacaactaccactataatgtacttttttttacaatacattgcaagaaaggttaattctattggaatatatgccaaaatagtattagtaaagaaaagaaaatagacacttgattgataaaatgaaagatataagattcccagtaaaatcaaataatataaccgaatcccattcattgttttatttagtaaatacatggttcctcctgtcttaacgcgctctcctagccattgtcccactatttagaaagaacagacttcattaattgggcataaacactgcgtccttccccattcaaatgagtttcatcatcataaaagtattctgggtggtctttgctgtggctaaaccagtcgatgatattgacattcttgtagcgactaggaagctctgctaatttttgattcacagattcttgacagccttccggacatttgatagttatccagtatatctgtttatcctttaattgagtaaggatttcatcgattgactcatccgaaataataccatttgtacccagtccgattactaccgtcgaataatcagctaaattgggatgcccttgaagaatcgttgccaaactagatatttgccgtgattctttcgcatcaacggttgcttgcccactaaacgtatcttccaattcttgatatgctccaagcatcacagaatcccctagaaataagatatttcctttttgattgggttgattctctatctttttcagattactgcttaactcttgtttcaattcgttttgatccgcagtcagacggttagtcggtgcaaaaatgatcattccgattgcaacagcaacaagacctgctccaaggtaacgtcctgcttttctttttaaatgcatgaaagaatgaaagccagcaatcatcagaaccgtcatgatcagaaccactaccaattcaattagaggattcatcttaggtgctatattcactaggagaataaacaccgaatagtgaaccaaatataattcataactaattttgcctatatattgaagacggaatttggcgattttggttcttttttccacttctttgtcatttatcaaaacgagtaatagcattgttaatacactgacaagcaatgagctacctgtaaacgaaggcagcggaataaagacagccagagtcaaacaactcatgatgagccaaaacttcgttactttttttgaagaaatgacatcattaatgttctttctattgaaaaaaccaaacatgccaactataaacggataaagtcgagcaaaggtattgtaataagcgatagaaaacggcgataacagactggtgagaatcgaaataatggtaagaagatacataagctgatagcctctttttctagacaaacgcatgactgttagaaagaagagtggaaaaactagataaaattgtaattccaccgccaaagaccagtaatgtttaaatagggacgaatttgcgaagcgatcaaaataagagactttttcgtggatctgccaccagttgttatatccaaagagtaaacttggaagttcacttttgatgtttcctagcattcggatttgaatactcccagctatcagaataaagataagtaaggagaataaaagaaacggataaatccgtttgatccgtttcttataaaagccaatccaggagaactgttttttttgatacgcataggaagcattctttgccatcaagtaacccgaaataacaaagaaaatcgttacgccttgatttcctccttgaaaagaatattgaggcaaatggtagagaataacagcaataaccgcaaatgccctaagaaaatcgttgcctgctgaatagtgtttatccatgtttaacctccggctggccgatgatcattttctccgtaataagtctcattgctggaaggattattcaaaagagtagctaaagacacaaattgataatcttctttttttaaatcacgaataatctcagggactgcagcaatggtttccggatgaatgtcatgcaacaaaataatcgaaccatcatagacagaactcgttactttatcaatgatcatttgggcatctttagatttccaatcttctgaatcaacagaccattggatgatgggacgattgatcaattctgcagcttttgcattgacagaaccatatggcggcgaaaataggctggttttttgcctgtgagtttcttgatagattgatcggtcttcgtgatctcattagtcattccagattcgttcaatgtgctgaggtcttgatgatcataggtatggctaccgatagtttggccatcctttgcgatggctttcaccacctcgggatacatctctacgttctgtcctactaaaaagaaagtagctggcactttttcttttttcaatagttccaataatttaggtgtattgctgggatctggcccatcgtcaaatgtcaaagcgacctttttttatttgaaggaatctcctctgtctctgtagtgctttctagtatattttccaaactagtctctgtagtagccttattgttacttgtcactgttcttgaagaactactgttgcttgttaactcggaggactgggacagattgttctctgtttttcctctagcaaattcctcactgattcgtgcacagccgcaaagtactaacaaaaagataaagccagttatgagtaaacggatctttttcattgcttttcctccttatttgttgtcaatacatcatgaactcttgctatctcttctgtcgaaactgtttgataagagattccattctgaatcaattcctctccgatcacttggtcatgaataattgttggctctttcatcagtttcttcgcatgaagaacaagattggtaatgggtagattggttttgatgttatctgtcaagatatcgataaatgcattccattttgtgacttggttcaattgcgccatattttccaaaacacctttcagtaacaactgttgccgcatttgtctgccatagtcccctcgtggatcctcatacctcattctcgcccaagaaagtgcttcttctggagataacgttagtttacctttaggaaaatcgaatccatcagaactaaactcaaattcattttctacttgaacagctcctacttctttgagaatcttttgaaaatctcccatatcaatagaaacaaaataaggaatttgaatatccaacattttttctactgttttaacggaacagcttgcacctccataagcatacgccgcatttaatttatcctgcattccttggtctgcgatatcaactaaaagatcgcgttcaactcccattaatgtgtattctttcttttttaaattgatatgagcgactatcatactgtcacttcgaccagaatccgttcgcccaaactctccagtatcaacgccaagtagcaaaacattaaaaggttcttgtttcaattggtcgtaatctaagtcatactgctcatctgaaggattcaatttttcgtacacttttgtatttattttatttgcagaatagactgcccagccagtaataccaccaacaaggactactgaaacaaaaagcaaaataagaattattttccgcatcggaacacctcctgctgctaaattaaaggaaaaatgtatctgaaatgtatcgatttagtatttggtgactcgatacatgctcgcttgtagcagcaatgttcgcttttaatttaatattaaaatgttgtatatcacttttagtgaagaagaaagtctactcatccccatttaaaaataacaatcaaaatgaagaataatgcatatattccctattggattttcatttcgattggatttgtttcaaacattttgcttataatatgcaaatatgaataaaaaaggcagaatatttgaataacagcaaacttttgggcatactaattacagaccctaggcgtaaataagctgcgcctaaataaaactagaggtgaaatcatgattgaatttcagcatgtatccaaaatctataaaggcggcaaagtggctgtcgaagatgtcaatctatcctttgaaaagggagaatttatttgtttcattggtaccagtggtagtggtaaaactacttgtatgcgaatgatcaaccgtatgacagacccctccaaaggaaaaattctgattgatggcaaaagtgtgaccgatatcaatccagtagaattacgacgccaaatcggttacgtgatccaaagcatcggcttgatgcctcatatgacgattcgagaaaatattacattagtacaaaaacttttgaaggtcagtcaagaagaacgaaataagacagcagagaaaatgatcgatctggtggaacttcctcgtgaaatgctggatcgttaccctcacgaattatctggtggacagcaacagcggatcggtgttgttcgggctctggcagccgaccaagatatcattttgatggatgaacctttcggtgctttggaccccatcactcgcgattcactgcaagatttgatcaaagatttgcaggaacgtttaggtaaaaccgtcgtcttcgttacccatgatatggatgaagcattaaagttagctagccgcatcgtgatcatgagcgaaggacgcgttatccaattcgatacaccacaaaatattctgcgaaatcctgctactacctttgttgaagaattgatcggtgaagaccgccttctgcaagcaaaaccagacaccacaccagttaaagaagtcatgctcaaaacaccaatcgccatcactcctgaaaaatctttacaagaagcgattcgcctgatgagagaaaaacgggtagatacattattagtgacggataatagcaatgtcttaaaagggtatatcgatgtagaatcgatcgaccgcaatcgaggcaaagtaaccagtgtcggggatattcttaataaagatgttttctatgtaaaagaaaccgccttactgcgagatacgttgcaacgaatccttaaacgcggtttgaaatatgtgccagtcgtggatgctgagaatcatttggtaggaattttgacgcgtgcttcattagtcgatattgtttatgacgttatttggggcgaggaatcctcccttcttgaagcgatcgaatccgcaaaaccagaggaggtctagccatgcaaagcttctttaatgaatatggcggccaattggtcacgaaaagcattgagcatttatacatctcctttgccgcactatttctaggcattgtcgttgcagtccctttgggcgttctattgacacgctttcccaaagccgcttctatcgtgatcggtgtgactagtgccttgcaaactgttccctcattggcactgttggcattgatgatcccgattttaggggtcggtaaggtcccagctattgttgcactctttatctattctttgctgcctattttgcgaaacacctatattggcatgaagaaagtcgattggaattatcgagatgtcgctaaaggaatgggaatgactaacttccaatcgatcattagtgtggaactgccgttagcgatcccaacgatcatggcaggtatccgcttgtcagcagtctatgtcttagcttgggcaaccttggcttcgtacattggtgcaggggggcttggagacttgatctttagtggattgaataactatcaaccggcattgatttttgccggcacaatcccagtgacgatttttgcacttttagcagactggttactcggattacttgagaataaactaacaccagctgcattaaagggggatgcctaaatgaaaatcaaagcgaaatttggtcttttgttatccatgatcattattttactctcaggctgctcctttccaggacttgcttctacatctaatgaagacaccgtagctatcacaggaggaatcacttctgaagctcagattcttggcgctattgtagcaggaatggtagaacattatacggacaaaaataccactgtcattaataacttagcaacaacgacaatcaatcatcaagcaatgatgaatggcgatgcgtctatctctgccgctcgttataccggaacagatttgacaacaacacttggcttagagccagaatctgatccaactgctgcctttaataccgtaaaaaaagaatttgagaaacgttaccatcagacctggtttccttcctacggctttgataacacatatgtttttctagtcagaaaagacactgcagaaaaatataatctgaaaaaagtcagtgatttaaaaggcgttgccgatcagttggttgctggtgtcgatacagcttggatcacccgtgaaggtgacgggtatgatggctttcaagaagcatatggcttttctttcaaaaacattttgcctatgcagatcggtctcgtttacgatgctgttgacaacggaaaaatggatatcgtactcgggtattcaacggatggacggatcgctagttatgacctcgtaatgttggaagatgatttgaatttctttccaccttatgatgcagctccagtagtcgatgacaaattaatcaaagacacaccagaagtagcggacgccttgaacaaacttgctgatacaatctccactgaaaaaatgcagcaactaaattatcaagttgataatgacctgttggaaccgacagtggtcgcagaacgtttcttacaagaaaataattattttgaaggagagtgacgaaatgaatgacatgaatctatttcaacaatttattgcctattttcaggaaaatggcggttatgtctttgcacagtttgttcgtcacttcctgatctctatctatggcgttttattcgctgcaatcgttggtattccactaggaatctggatttctaaaaagatgcgtatggccgattgggtgatccgcatcgccaatatcatccaaacgatcccttcgctagcaatgatctcgattttgatgattggaatgggattaggtgtcaatgtcgttattctgacgatttttctctactcgctcttaccgatcatcaaaaacacctataccggcatgcgccaggtagaccgtaatacactagatgttggtaaaggaatgggcatgacaagttggcaacgactgtatatgatcgaattgcctttatccgtctccgtgatcatggcaggtattcgtaatgcattagtcgttgcaattggaatcactgccattggcgccttcgtaggtgctggtggcctaggtgatatcatcatccgtgggacaaatgcaaccaatggcgcttcaatcattcttgccggagctttacccactgcattgatggcaatcatcaccgacttaggcttaggctttattgaacgtcggttagatccagcaagccgctcgtcgaaataaaggccatttcttagcgcttttataaatatagaaaacaagcatccttacatacaagaaggatgcttgtttttctatatttattaactaattcactcaaagcaggtgaatgcgcttctcgattttccctgagatgatcgggaatcacgcatcatatcctagaggtggttgtttcaaggctcgatccatacaaatggattggcgcccatcgttttgcttgagggacgactggtatgccatcattccatacttgatactgatatggggtcgttttttctcgaacactgctctgatcgctactccaaagatcattctgaagtttggtcgcttttaagttgtacgcttcgtcttccccctactttcttttgggactttttttccgatgaaccccatgccgttcgggtccattcctgataaacacaagacacattcttcagaatctgtctcataataagctgtaaattcatgcccctgccaaaaatagctcttctccatttgctgaatgtctgtaagcatgacaaattctgaagaaatgagactggactctgctgtaaactgaataatctcccacgttcctatgaggtcctctttcatagggatttcaggaattgatttcgcataactaattgctgatatgaccggccaaccactatctaaccaataaatttttctgacatctaaaaagaaatcatcactaaaaggttgtctccgtgcatgatgaataataaataattcattatctgaacgtttgaatatagaattgtggccaggtgcatagactgcagactgttcttcgaattgataactccctagtaatttaacaccaattttctccggtaccgcctcttgttccgacagagacaggccattccaatccgtatagggaccggtaatctctttcgctcttgcaacccggatattataggtttcattcaaagaatcaaaagagacaaataagtaatacatatccgtttctggatgataataaacaaaaggaccctcaatcgcagtatcaacagaagcaggtcgttgcgctattttttttccgtatcccttctcggctaactttccagtgctttgatctataggtgcaatataaatcccgccaaaaaatgatccgtagatcagccaatggtgtcccatacgatctagagcaagatttgcgtcaatggcattatgatcggcgatgcctcgatgcgttttcacaacttctccttgatctacccaaggtcccaaaggatgcggtgctgttccaagaccaataaatgaagtggtactgccaaatgtagaagcggaatagtacattcgatattccccttggtactctatcacttcaggtgcccacaacccttctgcttgactccattctcttgcagattgtggcaattgaggaaaggcctgcttttcaaactgccagtgtatgagatccaatgatgtccggatcggtattcctgccgttttaggttgttgcgtatctgttgaaaataagtaataaacgctgtctcgttcaatgatcgttggatcatgaacaccatttttccagttcatagattcttcctctcagtaatcgattcactttagtttgacttcagtgaacgaaagcagaatcgattcttttctatatttatttagttctttcttacttattacgccactttcattaaaaacaatctatctgctcttgatctttgctacctccaagattaccccaggctagagtttctataactgcttatggcgtaacaaacaggacagtcattgaatgctctgccctgtttgtgcccacattcctgcaggacagtatttttttgataggtttgcccgaaatttataaaagcagccacacttagtacaggtgtgattggaccgaaatgggcaggcttcacaaatttttatacgggactgaacgacttcaagtgcagcaaggtcgttctcgatggctagctgttcttcaatcaacgcttctacatctaccgttgctgctgtttccttgacatcgcaacctttacacgtcattgaattacaccgccaaagatattgtcaatacactcatagcgggtatattgatcgttaattggctattatttgttgtgtagtcttcaaatgattggatcactacgtcttccggatgatcaaaatcattgtgtgcattcattttatcccccacaatatagcgagcttctttgattccttgaatggcagtttcaaagtcaaaactaattgcttccgagccagatactgcgaaattgcagatcgacaggtggagggtatctgcttgtttcgagaccgtgtaggtgatcgtttcacttgctgctccatgactctcgatgcgttcggcatcttgatggactttgtacaaatcaaatacatgatagcttggtgttttgaccatcttttcgccatcagtcaaaatcattgcctgcaaaacattcactgtctgggcaatgtttgccatgtgcactcgttctgcatgcttatgaaaaatgtttaaggtgatagcagctaccattgcatcacgaatcgtgttttgctgatataagaatcctggattcgttccgggttcagcagaaaaccaagttccccactcatcaacaatgatgcccacccgtttttcaggatcatattgatccatgatcgcactgtgacgcgtaatcaattcatccatatgcgcagctttttgacaggtaataatccattctgcttcatcgaatgctaacgcactaccttttttctcccacccttggggatggacataataatgtaagctcaatccatccatcagccaatgggcattcttcatcaacgtttctgtccagtggtagtcatcaacatttgctccgccagccactttgtatattttttgatcaccgtattgacgaacgtaagtctgataccgacgataaagatcagcataatattctggacgcatatttccaccgcagccccaattttcatttcctacaccgaaaaatttcatgctccaagcttcttcatgaccattttctcgacgccaatctgccattggagaaattccgttcatggtaatgtactcgacccattcagacatttcttggactgtcccactgccgacatttccattgacatatgcttcacattccagttgtttgaccaattcaaagaattcatgtgtcccaaaatgattattttcagtcacacccccccagtgagtattgacgatcgtttttcgattttcttttggtccaataccgtctttccaatggtattcatcggcaaaacagccacctggccagcgtaaaactggaatcttgatattcttcaaagcttccacaacatccgtacgcatcccattcttgtttggaataggagaatcttctcctacgtataatccttcatagatacaacggccgagatgttctgaaaagtgtccgtaaatatatttgctgatcgttgttcctgattttgtatttagaattttgattgtcattgttatactcctattctttgattccccaaatggactcattattatcgccaatcgttgagaacgttaatttttgctgttcgaattctgttatatcctgagttaataaggtccctttgaaggtagtatctgcgaaggtcattgtgatgtgtccggcatcgtatgtccaagtcccggtcagctctccagtgatgtttccatctttttgaagctcgatcatttgtgtttttagcatggtcgttccattatcggtgccatggttaatgatttcatagcgtccgataatttcatctgctgtcaaagcatctgctacttgttcattgcctcgatactcatagggtgctggaactggccagccctcctcattcatatacattctgttgactcgcacttcatgggcttcggttccattgttaaagcgcgtatgatacaccaaggaccactgaccattctcatcgatgatcgccgaattgtgtcctgccgctcgataccccatttgttgaaacgagaattggtagttgccaatcaatttgataccatagtttgaattttgctctccttgttccaaaattggactatttccttgagcatcgaggtaaggtccttcaggtttttccgcgcgaaagagtcgcatattgtaaccaccttttgctgctaaaccaccgtaagtgacgaataagtaataataatcggttttctcatcataaacaatataaggaccttctcctgattggtgatagccgccaaaaagcttgattccgaaataacgatcaatgatacgaccgtcttccgtcgtgctatctttcccaggatacattggttttccagtggctggatcaacttctaataagaagataccgccagaccaagaaccataggtcatccatagttttccctcttcatcataaaacaaagctggatcaatggcgtttggcgcataatcggtgttatatgtcagaccatcttcgatcgcccagttttcgctgaaaccgctgatttttctctctttgatcaatttcgccaaacgggtattttgatagttagtattgcgctcactaccatctgtcgaatctttttctgtaaagccagaatagattacagtatccgcataactatagggaccttcaatcgttttagctacagctaatccaatcgctgaacggcgccaagtagaacttgcggaatagtacaacatataggcccctttatcaccatttgaccattcataatcagcattccaaatgacatctggtgcccaaaggctgtaaccaccttgtgaattggcatcatcgtagcctgcccattcaaaagtttcagctagattttcttttgtgttaccatagatcgtattgtcttccattgattcatattcgtaagtgaaaggtacttcccaagtttgtaaatctgcggttttcgcctgagcgagatgcgaaccaaatacgtaaaacagctcttggtcaccaacatgaatagaagtaatcgatgggtcatgaatcgacactcgattttttgtcgttgtttcccactccttttgtgaaagttgctcagcggcgtctcctgtttgacagccagcaagaaaaaaactagtaaaaaaaacggacatggttaaacagagcatttttctttttgtattcatttttttcctctcttttatcctttgactgcaccgggttcaccaaaatctggtagtccatttttatcccaagtaaacggttggacatacgcatgtcgattgggattttctaaaggattactataatcatttatttctggtcttgcatgatacactaagatctcttgtttcccttcctcatcgactgtaaaggagttatgtcctggtccgtagagggaattttgttccgaactcgaaaaaaccggttccttcaacttatgccaagaatatccattcaatagatcactatcctcatctgcccacaacagtcccatcacatagttttcatccgtcgcacttgctgaataagtaatgatcacttttccattcctaatcaaggcagcaggtgcttcgtttactttgaagccgattttttcccattcataataaggaatactcagaagaatctgctttcctttcaaagtccaaggattttccatctctgataagtaaagattagaattgcctggaatatttggatccgcttgtgcccagacataatacaatcggttcctgtgttcaaataccgtagcatctaagctgaaactttcaaattgcgtcttgatctgccctttttctacccactcaccttcaaagggatcttcattcgcattttcgatcgcaaacatccgatgatgatgctgatcatttctaacttctccatgatctgcagcagcaaaatagatgtaccattttccctgaataaaatggatctctggcgcccaaatcagctcactcatggggccttcggcatgagccgtccagatgacttttacttcaccgtcagccagtccttttaaggttttcgcacgtcttaattcgatttcctgatatcctggttttgatccagtgaaataataatatccatcggtatgcttgtatatccatggatctgctcgttctaatacaattggttccaaataattttctgccataaattctacaccttcttaaaaatatccatcttcagtttttaacgttcttaaggctttattttttgatatatacaaaatagttgcgagtaaatagaatacaataccgatgacatcatagatgactaaatgaatgatgacacaggcaatcatccatctcatagttcctttattgatttgtttatctctcatatttttagcgttgatccaactgatcacacccattaagatagtcgctaaagcaacgatcatgactacttttgagatcatacctacaaggcttgattgcaaatattcatactgatttttattttgaaaagcagcgatgccttgttcttcaaaccaaggataatagccaaacatcgtaactaacccaatcaacacatcccagacagcactgacccgtaataaatttctttctatttttctgttcataagtttcactatccctttattcccgcatttaagttcatagattcaatgaaatatttttgggcaaataaaaacagcagtactgttggaataatggcgatcaatgctgatcccattaactgtccaatcattcgataattgccataaatgtcttgtagtaatagcaaaccggctgtgatcggcattttactgacatccgtatacacgatcaccggccataagaaatcattccaagaaccagtgaaagaaaagagtccagcaacgatcagaacaggtttgatcaacggaacgatgatctcagaaaaaatcgtaaattcatctgcaccatccattcttgccgactcgtcaaattccagcgggatgcctttcataaactgtcgcacaagaaaaatattccccatccctgctaatcccggaatgatcatagcaagtgatgaattgacccaaccaaatgtttcgataattttgtaggaaggaatcaaattaactactccagggaacatagaaatccccattagaatataaaagatacggtctcggtatttgaaacgcattctgccatagccataagctgttacagaaacaacaattaccactaagatagtatgagtaacggcaataaaaagagaattccacagccattgcatgattggtgcagtagaagtattagccaagattgctacataattatctaaaatccagttaactggcaatagtcgaaatccagtagacacgatttcagtttgggaacgaaaagaagttgcaaaactaaaaatcaatggaattacccagataatacataaagtgattaaaaataaatatgcgactagcatactaggtatatgtttcttttgtgtattcatctttttgcccccttaagtattgtttttatctaatagaaaatattgaaatacagatacacacataataattagtcctaatatgacagccattgctgaagccatccctgcaattgattccccttgactaaatgctaatgaacgaatgtacatcattaatacagtagtacttcgatttggtccaccgccagtcatcatcagcggttgcgcaaaaacattgaatgcaccggcagttgtcataacaattgtatatagaagaggaaaacgaatagatggcaatgttacattaaagaatttttgaactggtccggcaccatcgatttcagcagcctcatataaatcttcatttactcctgccagagccgagcgataaatgatcatattcccaccaatcgctccccatatactgacaacaaatatcaagatccaagcatatggctgtttagaagcccatgaaaaatcatatccaaaaatattatttacagcgcctaatctcgagtgaaaaattagtgaccatatcagagatcccgctgatactgaaataagacctggaatatatagaattgcttgaaaaagacctttcattttcacttttttatgttgtagagccgctgcaatcatcaaaggaataatgatctgtaagggaaccatgatcaaaacgaaaataaaagtatttttcaaaccattccaaaattgagtgtaaaacgtggaagaactatcaaataataatgtcttatagttgtttagacctatccaaacaggatcagaaatcaaattccactgagtaaatgaagcataaacaccatagagcgttggaatacatacaaaaataataaagagaaccatatgcggtccaataaatgcaattgaagcccaattaatgttcttttttttcattcctttcattcccttcaaaaaatccgaaaggggataattttatcccctttaatttatttcgccacttccgcaattttgtcttctacatactgctgcatcgtagctaaaccttcatctaaatctagttcaccataagcaatatctgtacaatagacatctagtgcttctaaaacataagagaaataaacatagtcaaagatatatagtgtgtcttcttcttctggtgttgatgtaaagaaagattgtggatattttttataatcatcgctttctaaaacatctttactggcaacgatttgtccagctttagcccattcaatcgagttagtacgaacaaactccaagaattttgcgataacttcctttttttcttctgttctagactcactcttcagcatgccaaacatatgagaagctgctcggttggttgcgatgtcatctgaagtcgaataaatatttgttacaccccaatttagcccatcaacggcatcgtgagcggtggaagtccaagtaccatctgttgataagagtacgtttccgccttggaacatcaaatagccatcttctccataaggagtcattaaacctgcatctgttaacgcttttattttttccaatgcttctttcatttccggcgtattcaccgtcgggttcccagcatcgtcagaaatcgcgccgcctaagttacggatttgtgctaagataacccaagaaagcaaagcattattaacaacataatcgccttcatccatttttcctgctaaagacatcatttcatcaaacgtcacgatgttgtcgtctaaccaagaagtgacattgtatttttctaaaagatcttgattgtaatacattgcactggcatggatatctaatgggatcgtatattgagtatcgccgatttttcctgcatcccaagcagtatctaaataattgctctcttctaactctggttgatacgaaatcaaaggctcaactgtatcaagaatgcctgaattaacaaactcctcaactttataagaatgcattagtgtcaaatcagggataccatttttagagctaacaactgtacttaattttgtatacatatccgaagtaatcacatgatttattttgtaatctgaatcagattgttcattaaattcatctacaatcttatccatataggcaccgtcatcaccagtgagtggggaccaaaaattgattgtatatttttctttttctaaagcgcggtacctgttaaacccaacgagagcaactgcaactactgcaaccaatgcgccaataataataagtttctttttcatgatttaccctctttcattgaaattgaattgtaatctttgaagccaatagccctatcctcctcgtcaacactagttaaacaatcatgtataatttaattacttatattcagcgtttgcaaacactttcaatttacaactaaataataactttatttgtaatcgctgtcaacaatattttaattaaacaactctaaataatatatcaattaattaatatatatattaatagtaactactataaataatactatttacacaaattaacaaatatgttaacattcaagtaaatcatttataactataatgggggtgaaatgatgcaattagaaatcaatcaagaagcattgcccgtctatgaggcgttagctagtaatgtacggatcaaaatcattcaactacttgcaagaaacaaaatgaatgtgaaagaaatcgcacaagaattaggattaagcagtgctatcgtcacgatgcatatcaaaaagctagaagaagcaaaaattatcaagacagaacgtgtcggtcagcgaaagatatctagtctgagagtcgatcatatcgatatcaattttccagaaaaaatctttaatgcattcgatacgagagaaacgtcaattccaattggtcattatacaaattattcggttgaacccacttgtggattagccacgcttgctggttttatcggtccagtagatgaacctaaattttttatggaccccaatcgaatggatgctcgcatcctctggtttacgaaagggtttgttgagtaccagtcacctaattttctttctctagatgagaaactagagatgatggagatttccatggagatttcttctgaattccctttttctaataataattggccgtctgacattacctttagcttaaatggcatcgagcttggaacttggacaagtcccggtgacttcgccgatattcgcggcaagtatacgccagattggtatcctgataacttaaatcaatatgggttattgaagacgattcgaatcatggatcatgggacttatatggaaggagaacctttatcagacgtcacgatcaaggatattcctgcttatgaagatacttggcatttaagagtcgaggtaaaagaagaggctgaaaatatgggcggttgtacattgtttggcaaagggtttggaaattacgatcaagacatcaaaatcaaaatgttttacagctaaacgtttttaggaatcacaggcacactctctcatcatttttgatgtgcggtaaaagattccttcgctgaaaataagacaaaaaagaccatctcgctcgatattagagttagatagtcttttttgattataaaacttaatctatttcttcaaatgataactgtaagttcctacgacaatgttttcacgccatgataaacggaatcttagacgcagacttgtttggttgtgtaaaatattttgccagcgacgacgtggcacgaactgtggaatgataactgtcgtcgtataattgtgtttcgttgcgtttttgctgactagatctacataacgaatgattggattttcaattgaacgataagaagaatgcactacagaaaaacggacatccgggaaattttgtttgaactcttgttcgatttctttttccttcttgacatcttcatctaaagatacgtgcattgcaactacataatctccgatggattgtgcataattcaaagccccgatatttacacgggtcacatttcctactaatacaataacggtattgccatcatatttgtggagtgccacttctttttccaaacgtagctgctcagcgactttcttataatgatcatggatcttataaaagacaaacagtaggattggcatgatgataaagaatggccagatgtcacctagacgaaaaacaaacaagatcgcaatgatcgcaaaagaaatcaacgctccgacgatgttggccaatgatttcaagaaccatcctttaccagctttcttccatcgaactaccattcctgtttgtgagagcgcaaagggaatgaacacgccaatcgaataaagtggaatcaaccgttccgtcgatccttggaaaatgaacaatagaacgatcgaacctgctgccagcgtaatgatcccattagaataacccaagcggtctccccgatcttgatacatatgaggcatatacttatctttcgctaagttataggctaacactgggaatgcggagaatccagtattcgctgcaactgctaaaatcaaagccgttgcgaactgcagaacgtaatacatgaatccgtgaccgaagatcgcagctccgatttgcgaaaggaccgttacttctgcttctggaacgattccataccaatagttgatgaatgtaatccccacaaagaagaaacctaggatcgcagccatgatcgtcaatgttgcagctgcattttttgctcgcggctttttgaaaaacggcacagcattactgattgcttctacccctgtcaatgaagaagaaccagaagaaaaagcgcgtaagatcaatgcgacagaaacccctggcacaacagcacctggtaaggctgtggcatttaatggctgtaccccagtgataatattaaataatcctacaagaatcaagatcgtgatcacagcgataaaggtgtatacaggaaccatcaagaaactcgcagattctcgtagcccccgtaagttcatcatcatgatcagtaaaacaatagtgatcgagatacccacctgatgcccatatagagcgggtacggcagaagtaatcgcttctgccccagccgataccgaaacggcaacagtcagcatgtagtcgatcaataaagagccgccagcaatcaaacctgcattcttgcccaaattctcactactaacgacatacgccccaccaccatgagggtacgcatgaatgatttgacgataggataaggtcaatgaaatcaacaagataataacgaatgcggcgatcggtagtgaataccagatagcagcagctgacaaagcaactaagacaacaacgatttgttcggtcccataagcaatcgatgacaatgcatccgaagataacaaagccaacgcggctttccttgtcaatttttgttcatcattctccgcggatttcaatggacgtccgaccaacaaacgtttcaaatattccactttcttacactccttttttcatgaaaaagatcataattgcacatacaaaatttctttgataattactgaattaacaagactgtatgctactcctgaaaccgacaaaagtcaatgaaaatggcatgaaaaatttgaacaaactccctcttctttttatcagaattcgcaagaagattcaagaaaagcagatagaacatcgtgccctatctgctcttgattttttaatggaaaaaatgactctttttcgagacattatttagtttcttagttacatctgttagataaggataagcccatgttcctatgatgccaaatacaataaacaacagtgacaaaataatcaactgaggaatggcgtttggccaatagatcccgccggctgattcccttaacagattgactgcatgggtgaatggtaacagcggattaataaattggaaaaatttaccagagacttggatcggataatttccgcccccaccagaaatcgatagaacaaggataatgatcgcgatccctttcccgacattgccaaacagtccggctaagacgtagacgatcatcataaatgctagtccaacgagtaatgcgaacaagacgctgtataccggattatgaacatctactcctaataagaacatatttcctagtgtaacgatcaagctttgcgcaatggccatagttaggaaagtcagcattcgagcaacgaatgtttctcgttgcgtaaagcgttctttatctttcttctctaaatgatactctgttgtagccacacttgacaacaataacgccccgacccataaacacaacgctgtatagaatggagtgctggcagaaccattgttggcaatcggatagatgtcatttgtttgcaattcaactggttgtttgaagaaatccgcttctttagttgcatcaagcttcaacaacttgatgatctcgcctagatcaacttcactttcacctttgcgaatcgcattggctgccttatgaatgcctgttttgatatttggccaatcattattgatcaaatcaactgccgcattcaatgctttttctacatctggcagtttctcatcaaccatgttcatggtcgaagtgatttcagctttgatggttggccagtcattttgtaagaaaccagccgcaatccctaacttatcttcaacgattggcagttcattgttgtaaagatcggcccctttgttgatggctgcgacgatctcatccatgtgaccattgagcatcgtattggcatcatgcaactcttgcttaatagcaggtaattctttttgatacttttctaagatactgatagcattgctgaccacatttttggttgatgccaataaagacttgaagtcaatggcttgcgcttttttcaatacatcttgagctgtggtgatggtggtgatcaatttagtcaacacattgtcgatggtatcggtaatattcgtcacattaatgccttttaaaagatccgtaacattttgtgcagcagtgttgacttcagttaaatagtcggtaatagcctctgtattcccatttttgaccaattcgcttaaatgatctagccgcgaagaaagatcccccaagagactttttgcattcgtcaattgattaatgatccctgataaatcggatgtgttgcctgagttttgaagattcgttaagaaagtaatcaagccatccagcgctgcttgttgccgttgaatattttgttggaaatcactgatgaccttttggatgttttcccgttcttggtcggtcaattgattgtcagcaattgcttgtttgattgtattcgttaagctaactgtcgtggtagcgacttgactgatggaatcaatcgttacttgaacactattagaaatacttggtagcgcatcttgtaactgttgggcaccttctttcgtcgctgaggcaaagtctgttgcttggtcccctaattgttggatttctggcaatgcggtttgtacttgatcaatgatttgcagtccttgtttagctgtatcaataccatctgtcattgtactagcaatagaatcaaaatcatcatcgatcatttttaattgcttgccggcattttggatctcagggatctttttctgcaatgtcagaatgacactagcttgtttttttaattctggcagcttgtcattcaatgcgatcagtttatcccccatttcatcgacctgaggaatataatccgtaaattcttcggctttggcgattttgtctttgatttccgggaacttgtcatgcaaatcaacaatttgcttcgtgtaactatcaatggtgtcaagattgccatcggtctctaaaatcatatttttgactttattgatactaactagatttgaatcaatatcatacccgatttcgttgaacactttgactaatgtagaactagcagtttcaataaagttctttgagatctgttcttggagactgcttgctcccttgtcagtaatcttaggtgcgatagcattgattttttggttactgtagtattcaattttcggtttaacgatcgtaccgctggtaaaactgaccagatcttttgaaaaatcagcaggcaagtaaattcccgcgtaatatttacctgatttgaccccttccactaattcttttttagaatctagaaaatgccaacctaactgtttattttcatgtaaagagtcgatcacttcattcccaatcgatagctctttcccttggaattctgcgcctttatccgcgctgtaaaccgcaatgggcagttcactagtgtttccatatggatcccataatgctttgatattgaaccacgcataaagcgagggcaaaatcatcaaagcaatgatcaaaaaagcggaaatcggattactaaaaattcgtttccagtctaatttgtataaataaaacacgtttttgattttgttcattttctttcccccacttttcttcgtcgaaggataatttaccacgttttttgtacgccgccaatgggaatgattcccttgatatcagccttttgacaaaaagtaccatttgtcaaaatgaaacccctttacttttcgcgtaatttcccttattattaatcttttctttaactttaacacgactgcttttggcagacgaacaatttgtttgctaaaagcaatcataaaaaaagcaccattgaccgtttcccttgatacgatcaatggtgcctgttctagtttgtcaactgctcagtggccaatagttgataaacgtactcaagagaagtcgtttcggcataaaggttcaaacctgctttttcatcagctgaaaaatgatgagtgaaactttgatccggtatcaacaccacttgaattcctgcccgagttgccgcggtagctcctggcaatgagtcttccataactaaagctgattcagaggttcgtgctgcttttttcaatgtcagcaaatagggagccggatctggtttgtgtgctgggacatcgtcaccaaatgtcttgaaatcaaatgcattctgcaattcaaaatgatccagtagtttttcacctcgaaaagccatcgaagaagtggctaatgctgtctttaaccctttttctcgtgccagagccaatgtctcacgagcaaatggttttggctgcaagtttccattgagcaattggtcttcaatgtacccttctcgttcttgccgaagttcctccacacgttgaagaccaccaacttttttcgctagtaaggttgctgtctgttgccaactttgcccacgccaagcaacgatatctgctgatgtgatcggtagatggtacttttcaaaaagtgccaaccagccttcatgatagactctttccgtatctagcagcaatccgtccaaatcaaaaatcaataattctttcatagactctttactccttctctccttcatactcaagcagtttcaatataagtattttaatcaagacatttgacgattcttttcggcagctgcatgaacagccttcatcaccgcagcacgaaagccattttcttccagtgtttttacggcttgaatggtcgtaccaccaggagaactgacattgtctttcaatacaccaggatgttctttggtctccagcaccatcttcgcagcgcctaaaactgcctgagcagcaaattcataggccatttggcgggtcattccttcggcgactgcgccatcggccaatgcttcaatgaacagataggtatatgctggggaagaaccgctgaccccaatcacagcatcgatcatggattcaggcacttgagctgcttttcccatgctttcaaataatttttggatttctgcagcttcctctacggtcacatgcggattgttactgatagacgtcatcccttctccgactagtgccggagtattcggcatcactcgaacgatcttgcgctgacccaaaacttcttccatctgcgcaatcgtaacgcctgctgcgatcgatacaactaactgttgttcatttaattgcgcttttagatcctccaataatttaggaaacacaaacggtttgacagctaaaatcaaaatggaagcagctgcggcttcagaaagttctaatgtaggggtgatccctaaatcttgttccaactgtttaagtgtcggttcataccgatgattgtagactaaaatttcctttggttgatatagttccgattggatcaatcctttgataattgcttttgccatatttccggccccgataaaggcgatggttttcataacactcactccttctaacatttatgatcctatgttcgctgtttcttgtaaaaaaagcctaatcaagagattaggcttcaaactcgatcacataaggatgcaatgctgtattatagatgccctctgtatattctaccacttctccatgcagatcataagagcgacggacgcgctttaaagcggaaatctctggtgtgatcagaaatttttgttgttcctcattcaacgtcagtcctgcaaatgaatcttcaaaggtatcgatcaccatccgatgttcatctaaaatacggtacagtgatttttcttccaattcttccatggcaaggccttttaacaatttgggcaaatgatattcataataaataaatggttgatggtcaaaatagtacatgcgccgcaaacgcatgacttctctgcccatcaaagcagaagctggatgatcttctgcgagctcgactaggttaaaatcaagatttttcttggtatattctttgccggttttttctaataactggctgaaagttgtccctttagacaacttgttataaggtcgattacttaaaaccgtggtcccgcgtccactgcgcttttcgacatattcatctgctgctaatagctcgattgctttgcgtaccgtgattttactcacattgaaggctgcttctaattcggtttctgtcggtagaaaagaaccaacaggatagtgtccggacatgatgtcttctttgattttatctgccacatcacgatataaaatatgtttacgcttcatttctttcctcgcctttccagtcattgattctctctcaaaaagaggacttgcacgttactcatcaaaacccggcacttcttcggctgctgcttcgatcagcaccttccgaggcttactgccttctgaaggacctacgaccccttggtcttccaattcgtcaacaagacgggctgcccgattgtagccaatccgaaagcggcgttgtaataaagagacacttgccgtctgcatttcgatcaccaatgctttggcatcatcaaatagttcatcctgtggttgaccactgctggtacttgccgtatcttcttcggtaaccatcattttctcttcgtaattcgctccctgctgctcggtaacaaacgacacgacccgttctacttcgtggtctgagataaaggctccttgcacccggattggtttattctcacccataggcaagtacaacatatcgcctcgtccaagaagtttttccgcgccgttgctgtcaatgattgtccgggaatcgaccccgctggaaacggcgaacgccattcttgaaggtacgttggctttgatgattcctgtgatgacatccacactaggacgttgtgtcgccaagatcatatggatccctgcagcccgcgccatttgagctagacgaatgatcgcatcttctacttcattacttgcgaccatcatcaagtcagccaattcatcaacaatgacaacgatgaatggcaagattggtcggttttcaccatcttctaaatttttattgatcactagttcattgtatcctgtgatatttctaactcctgtcgcagcgaacttctcataccgttcttccatctctttaaccactttttgcaacgcttgcgctgctttccgagggttcgtcactaccggagtcaatagatgaggaatgccattatagacattcaattcaaccattttcggatcgatcatcatcaatttgacttcgtggggttttgcccgcatcaaaatacttgtgatgataccgttgattgcaacggatttcccactaccagtagatcctgcaatcagtaagtgaggcattttcgttagatcggccgtttggacacggccagaaatatctctacccaaagggacttctaacaacttatcgggatgatccggctgtgcttcaatcacctctcggaaggaaaccatgctgacagcactgttaggcacctcgatcccaatcagtgattttccaggaatcggtgcttccatccgtacatctttagcagctagtgccagtgcgatgtcatctgttaagccaacgattttgctgactttgactccgactgctggctgtacttcaaatttagttactgctggtcctaaactagcttttaccaccttggcatcgacgccaaagctttggaaagtcttttctaaaacaccaatgttttgttcgatttttttgtactcgctgctttgatcggttgcagggatcgagtccaacaattcagcggacggcaactcatagtcgcgattttctgcttcttcggaaatttcaaattccaatacttcgccatcatcttccatttcttcaacgctttcttttttctcctgtgccgaagccggagaggatgatgcagctggcggtgttttgggcaattcttgaaaatgatcgattggcacaaaacttaactgctctggttcgatttccgacaaatctggttctgattgggctgctcgctcttcttccgtgaagggacggacttgattcttttctttgatctcagccaaaacagcagaacgctctgcttcttttttcgctgctttttcagcagctttttgcgcttttcgttcttcgcgggctgcttgtttttcaggtgatccttccaaccattgctgaaccttttcaccagcgtgctgcagatgctccaacaactcgtgactgctcatcttactgaacaaaaagcccccgatcatgatcatcaagacagctaaaatgtaactgccgatctgggatacaaggaaataggttccgcgatagaagaatgcgccgaccatgcctcctcccacattttgtgaaacttgactgcggcgaatatcatccagcaatgtcgaccaagtcgtctgcaagacattcggcgattcattcatgacattattgaataaatgcgcatgcaggatcactaagatccccaaatagatcagcacacagccaaccactcgacgtaaactcgtaaaacgagcttctgtggtcttgattgccaaccatcccccgtaaacggccaatgcgagacaaagcacttgatacgtattgcctccaatgatacgaaagccgttagcgatcagcgttcctaaaaagcctaagtggaaaaaaccaaagatcgaaaacaagatgaaaagcaagccgatgccgactagaatcagtttctcttgttgtttttgttgtttttttgttttgcgtttcttcgcgcgttttttttgcgccattcttatccctcttttcgtctctacctattataacgaaaaaagaaggcgaacaaaagttttcctgtcagaaagtttactactagaaataaaagatcccactaatgaaaaaaagaccgctccataaatccatcaaacaaagacgatctaaaggagaaaagacaagaaatgcttcttaaaaatctctttagtaagactacagttaagctaccttgcacctgttcatcaatcgcttcatgccaggtagctactgtgatcgtttttgttgtggcttatgtcgccgtcaatcgtttttcatttattcaggagaaacatcttctccaaaccatttttcggaaatctcagcaaatgtgccattttcttgcagtttctttaatccctcattgattttatccgccaatgcttgatcgtcttttcgtactcctactgcaaaattttcggctttgaagggactttcaataacattgtaatcgtccgcttttttcgtctgagtcaaatagtactccgcgtagacccgatcgatcaaaagaccatcgatccgaccattttccaaatcgataaacgcttcgttgaaactagcatataaagttgcttcattatcggcgacaatgtctttcaatacttctggttgattgttgaaggtatcatagccagaggatccttcttgtgcccctagaactttgtctttcattgcatcaaatgaagtgatgttgctgtctttggcagttactagaacctgcttgttttccatataagtatcgctgaataatactttcttttcccgggcttctgtttttgtgtagccattccaaatcatatcgattgtaccattatctaattctgtttctttcatcgaccagtcgattgcttggaatttgactttggttcctgttaaatcaaaaacggcttttgctaggtcaacatcgaaaccaacgatgtccccttggtcatcttgaaagcccatcggtacaaaggtatcgtccaacccaacgatgacttcctctttgtctgcagcactttctgctttctcgctactattgccacatgcagcaaaaagtaataagctggctccggctaacaacgttaatccaatttttttcatttttcttcctccttagttcccttcaacttctaataattgatcggcaatattttttgcaaaaaccagatcatgggtaaccacgatctgagtaacgccctcttttttcaaatctaagatcagtttttcgacttgctggcgcagacctggatctaatgcactcgtaggttcatcatacgccaatactttcggatccatcgccatcgcccgcgcaatcgctacccgttggcgttgccctcctgaaagttggtaaggatattgcgttaaaagttcagataatcccaactgtttagccaaagcaacagctttttcggtatagctagctttgtcttgtttcaataccatttttggtgccagtgtgatgttatcgaataccgacaaatgcggaaatagctgaaagtcttgaaaaacgacaccgactacttgttcttgttttttcgtatccgtgggatcaaaaggttgtccatctagtaaaaaagttcctgaatcgatggtctccaatccagccagggtacgcagcagggttgtttttccaccgccagaaggtccgactaccgctaggatgctgccttcttcaattgtcaggtctaagcgatcgataacctgcttgtcgccaaatgcttttgatacttgtctcagttctaacatgttcctacgcctcctaacggtaataatcgagttttgtttctaactgtttcaaaatcagtgtaaaaataccagtcatcattaagtaaatcagcgcaacgcccagtaatggtaccaacgtgctgtctcgttccattgcgattttaccgatacgcataacatccgacaaacctaaaatatagacaagcgaagtatcttttactaaattgatcacttcgttccctactgaaggaagcgtgatcttgactacttgcggaatgataatcttgcgaatcgtctgtaaaggtgctaggcgcagaacttttgctgcttcgtattgccctgcagggattgattggatccctccccgaaaaatctcggcataataagcggcataattgataataaaggcaatcagtgctgcttcaaaccgatcaaagacaatgttcaggatcggcagaccataaaacacaaagatcagttgtaacagtaaaggcgttcctcgcatcagccagacatacacttgcacgattgctttcaagatccgtagtcgactagcaagaataaaagccaagatgatccctaatggaatcgatcctattaacgttaatccaaacaatttgattgtgatccctgccccagaaagcagttgcggcatcacacttactaaataatcgatcatttctttttgcctccttgattttgcggcaatgactgcttgcttgatttacaatcaccaagcaccatcttgccgtgtttccacttgattaaaatcattaaaatgaaaggcgcccaacaaaaaacgccctccggcctaatgccagaggacgtttaatacgtggttccacctcaatttgtttttccttcacagaaaaaacctcatgcagtcagttgatggatttgctgataccgccattaaataaaaaaagtcctttagccattacagctaaaggacgttatcaacgcggttccacctttgtttatcagtgcttcacagcaactgatctcagaaagtcatcaaacaatgactgctgctataacgggcactcccggtctttcctactcgattcagaaaaacgactccaagatgtggttcacaagtccttgttgtctcttctcaccagccagagactctcttaaaacgaagaaaccttgctactcttcttttcgatgtctgtttcattaagttgtttattactttatacgcaaactgaaaaaaagtcaaatactttttttcagttttttgatcggaaaattcattttcacaaaataagagacgaatagaaacattctatccgccctaaatgcattttagacttcgtaatgatcagtacaactttgtattccctctatggtactttcagttgaacatgatagcgatagcggtccccacgataataaatttcagcatattcaactaagcgatttttgtggtctttagtcagacgctcgacatataaaagtggtgtattcatttcaatttttaataagttggagagttcttcatcagacacaactgactcaatggtttcttgtgctgttgttactataaaaccttgactacgcataatttgataaagtgatgcatgtttgtcagcaagatctttttcttttagctcaatgtatgatggacaatatactcgttgaaatccaatacattgatcatccacgtagcgaaggcgttcgtgtttgctgacctccgctccttttggcaaatctaacttactacacaacacctcatttgcttccaaagatgtatttaaagaaattaactctgaatgattggactgcagtttattttcttccgaaaaacttagaagggtttgtaattgcagtaattctttcgtactgagtacaattgtacctacaccatgaattcttttgataaaaccttcatctactaaaagttgcaaggcatgacgaactgtaatacggcttactccgtatttttcttgaagttccggttcagtcaaaaaaggttgcccaactggatattttccttcattgatttcttttttcagctcttcataaatcgagagatattttacctttggacttatcattttcattcaccacatttgctaaagattcagccaaactagttaaatcgtagctattcgctgattgaacatcacgaaacagtggcgtaaaacgttcatcatctggatcaatcaatgccccaaccatggatcctacaattgtcgcaatcgtatcagtgtcgtatcctacattcactgcatctatgatcgcattaaaaggatcttgtttgtttagggcgataattccaaacgcacacggaactgcttctgagatatggagcccactaccgatgatttgagctagtcgctgtagtttttcttcatgggtaccagattcattaactatagtatacgctagtttcatgcgttcaacaacgctgggaccgccaacttctcgggaataaactttgcctaattcttctccccgacaagcgccataaatccctattgctactaattggtccacagttgcatggtcacacaaagaggctgacactgctgccgcaactgcagctgctccagaaatagccagtgcattatcatgagttacttgcgttataatcaacgcttcttgaatagctttttcaatatctcctgggtttaatatccctgcaggtgcgattttcattgcagctccgttcgtagcttttgaagcatagtctacagccatagctcccggtaaaggcgccattttttgatcaggatttttatacattgcaatcgcacttcgcgtagttggacctgcaaatcgatcgaagtaccatgtattttctgaccatttcaagatggctgtcttcactgtttcagaatcaattactcctctattttctataatactgtgacacaacgtataaatttgcgaaaaatcatctgtgacttgtccagcttcattccctaatgcaaaagcaccttcctctggttttaaaaaggtagaaactttgccattgaactttgttctaatttgatcaaaagtaagattttctgttgcagctcccatagcatctgcaatagctgctgcccccaatgtaccttgaatttttatttgtaaactcatataaactatctccattctcttattctttatttcatttcagcttctgggtcttttatacctaaaatgattgttaggatcattccaccaaaaaatgcaatcaccaaacccacaatgtacgcccaaagtgtaggacccgcaaaagctggaatggtggttaatcctccaaatacaaaggcgttaccaataacattaaatgcacccataaaagctccacccattgcagcaccaagacagccagcaatcaacggtgttttaaattttactcctagaccgtaaatagcaggctctacaattccagataaaaagacagaagtaattgcagtcaaagaaaagttccttaatttggtattttttgatcgtaagaaaactgcaaatgctgctcctgccatcccaaagtttgcagttacgccatacgcaatgaatggtgagtgacctgtgctagcgatttccggaataataaccatggtatttggtgcccaatgaacaccaaacatgatcaaaatattccaaatgccacctgtaattgcccctgtaataatctgattgattcctgctaaataatttacaaatccagcaataccaatactaatatagttacctaagggaccaaaaatactggcagttacaggcactaacacaaacaaaagaacggttggtatcaaaatcatatgcaaactattcggaattgtttttttcatgaaatgttccattttcgattgtacccatgttgtaaaaattgcgggcagaatctgcgaagtgtagttaaagactggaactggtaaaccaaagaaagaaatcgtattgcccccgtccccttggatcaaattaataaagtctggcataatcaatgcaccagcgactgcaatggcaatataaggactcgttttaaatcggtttgctgcagttaccgaaactagtaacggtaagaagtagaagacagatgttgcagcaagtgtcaacatcaaatttgtcgagctatccgtagataaaattccgacctcatttgcaagaattgtaaatcctcgaagaagacccgatccggctaataaaggtaataaaggcgagaaaatactcactacgagttgaacaaactcatttattaagctcttttttgtctggactttagaatttttttcattggtcgtctcattattttctctattcaatacttttaagaagtcttcataaacttcccctacattcgttccaataattatttgatacccggaatctttattgactactcctgtcacaccatccaataattctattttttcactttgaactaactcacgtttcttcagacttgggcgtaatcttgttgcacagtgagtaattgactcaatattttctgttccgcctagatactctagaatctgctgggctaacctttcatttttcatgataaatcccctttctataatgaattagcaagtcgttatgacgtcatatcaacatctaaaatatacccctaacgcccttgagtgtaaacgattacaaaagaaatatatccaaagatttatttatcactcataaatctgctttcaagatttagcttttttgaacacgttctattgaaactattttttaacactttagttaaaaagaggatagaaagaaactccctgtgatctctgttctaagacgtcttattctaatcatattataatctgttttaatcaaagtaaacattaactataaaactttgaactgtaagaagatgtataaagtccaccaaagtagtttcatttagaaaaatttatcaagtatatctattattcaactatctcatttctaattttattataaattaatgagtttgtatcagacacccaaggaagactctctcgtcaaatctaaaaataaaaggatgaatttgaaaatttattgagttaccctttattagatgatacactttttaaaaaggagttttagcaatgaaaaaaatctgttggattttttctatcaatgttcggggtatggcaccattcggttacagcacaacaatgaatcttagacaagcaaaatcatttcaagaaaaaatcaagacactcttaccagcagaaattgagactcaatttattagttatgatatttcaagtaatgatattcctgctgcagatttacttgtttttaatgatatggattcaaactatctaagcgaagaaataaaaaaacaaggcattgctgtttcttttaaagatatggtttccggaaatactacagttatcagaaaaacaattctgaacgccctaaatttaggcggaatttgaacagtttttctgcttgtaacaataacgacacccctctcatacttatgaatatgagaagaggtgtcgttatgtattatttatctttcgtcctatctaaaataaagcaagtaataattgatctaagcgcctagataggtctctactaataagaacactgattatttgatatcttatcaatattcataacggggagaatgaagagcataaaactagatagctttttctttattcgttagttatcgttctatctgcttttaatccaaacgtaacactttcaaaaaattacatttattgtttttcgaactatattgtatgcatttcttcaatatcaagtaatgacgtacgattatgttgttctatttctgatgctcccccctataacagatgttactgcacttaaatctagtatagcaactgaaggtttaacaccaatcctaaattttttccataactcttctttgattgtatggtaagcctaccatgatgctccacaatcaaaaaaatagtatctttttgcactatatatgtatcaaatcactatgttatagtttacttaaggagggagaaaatgaaaaagatagtactaaaaaataaaaaactgcttgttacgcatgtgattatttgcgcaatcgctgcgcttattcaggttggcgttgcacttgtttatagccttatcacagaagttgctatgtcaggaaatatacaaaagcttatggttgttggcttattcgccttcttttatatcttattaaacaccatgagcgactttgtccccagacgcagtaaatctatcttggtccactcaataacggatcagctgagagtcggcctctcgcaaaagatagtccgaatggatccagaaaagtttttaaaaagcgaaaaaaattattacctttcaaagctagccaatgaaataaaagttattgagcaagaatttttgaaacctggatttggattggttttaagcatctttacctttattttttcacttcttttctctttaagacttagtgcttccttttcaattgtcatgctattgctagcctttagccccttgttagctccttattttgccaaaaaaattcttggaactcgtcgtaaagcggcggtcgaggcacaagatcatacactcagtttatttgaacaacttctttctggctatctgacactaagagtaggcagaggattcccgaaatatgctacacgtttttctgaaagtagcgagcgactgaaaaagcaaaatattcattttgaatcgttacaaggacttacctacgcgatttcttttggtcttggcgaccttgcctactctggaacgtggattattggtggtttttttgttgcagcaaaaataataacccttcctaacctcattgctatgactaccttaatgagtacgattgccggtccattggaatatttcagcacctcgattaccgatattttatccagtaagaaagtcgctgatgatcttatatcttttatcgatagtacagatgatgatgaaatgactcgatcaatcattcttgaaagtcccatcacaactttgtcgattgctaacttaagctatagttatggtacccgtacattaatcaatgaattaagctatcaatttgaaagagggaaaaagtatgcaattacaggtgcgagtggcagcggtaaatccacgctattgaatattttagcaggcatttattctgtcggtgaccgtcaactatttatcaatgaacaagagatgaatcaaatttctagagattccttgtatcaaaaagtctcacttgtccaacaaaagaccgctatttttcagaccagtattgcttctaatctctctgtttttaatgattttgaacttgaaagagttgttgatgcattaaataagagtggcttggccaatcgctttaactacgagaaattattagaagaccaagaaaacaaatggataaattttctttcaggaggggaattaaggagaatcgaaatcgctcgcgctgtctttaaaaattccgatatcattctattggatgaaccgacttctgggcttgatagtggaaatgagctgattatcaaagatttgatcaactctttcaatgataagataattatcgtagttactcattcaactagtcctgattttctagactcttttgacgagctgattcacttagatgctttacccctcaaaaaacaaaacaatccctttattcgcttgtctttatgatttcctccttgaacttgttagaaaaagaactgaacctagtaaaatgttctttgtcatactactaatgacaaagaacgtttgagggttattgtttgaggctcattgacttcctactaaaataaaatttcatcagattaaaaaattcttcttactctatgttaacaaaatattctgctattaaattagttatagagcgcgacactttacaatcaccgttactctaagcctttctttagttctcgcattcgctgcatccatcctacgtcttctacagtaactattacttaataacaaaagaacgatacttggaataggctatttgatcgataatagtaaaaattttctttatctctaaatctgcgccgattgccgttacttgatagaactgactgtaactgttccctaatgcgggaaggtaggcattagagatcaataaatcaaatggttcatcacttgtatagggtaggagaacaacgtcttgtttccctttcaactcattttctaataagtaaatagaggcatctgccaaaatactagagcccatatttaagaccgctattctcacttgatactcctctttaggagacagcatgtaaattaagaacactaatctttttttcaaatactttaatttcgtgtggttgaacaatttagtcggttcaataatattttctattatgtctaagacaaactgatttctaaacgaattgttaaacaagttatggtaataattcaaagtgactttatcgatcgaataattgaccccatgaaaataataaacttgggcgatgagagaaaagacactggatttaatggttgaatttgactttagtttataaatcgactggatcgcggccattatttcatcggttatctcaaagacgggatttttgctagtatataatcctagtcgaatttcctcataggggatcccaccaactgtaattaaaaataagcagataaaataggtgacgattgtcgcttcatctgatgaacaaatatatttttttgaaaaataactatgccgaatgtatttaaaaactggcatatctagacagcgattgatctttatttgctcatcttggcctacttcgctgtcttttgactctggcgttaaaccagtgacttcttcaacagttggcttatctgcagtgtagtgctcaatttctggactagtcaccgcatcaaaggttgtgtcatcgtctttggcttgccactcaccatacgttgtttcctctgtggcttcattggtggtgactgttcgggtgaaagtgactgtatccaccttgtctggggcggcttctgtaccgtcttcatacagataatggatcgtttgttgcacttctttggtctcggttgattccaccatgtttgccttgtaagtaaccgttacttcgctgtctttcgattctgctgtcaagtcaaccatttctgccacaccttttttatctggcgtgtagttggctatttctggactgaccaccgcatcaaaagtggtgtcattgtctttggcttcccaatcaccataggaggtttcaccggttgcttcattaatggtgactgttcgtataaattctattgtatccacatgatccggcgcggcttctgatccgtcttcatacaaataatggattatccgtgcgattattttactttcctctctcgtttctattttagggctgtaaacatacgtgactgtttggggatttttgctaacgattcctgtctcatcaccttgcacttctttcaagatatatccagggatatctttcggagtaatcgtatatgaatcgcctatattgccaccagtcattatacttggaggaagtaattctttcccctcttcatcgatataattcactgtgattggtgccccttcaatataccttggctgccatacataggtatcagccatagtcgctccatcataattcaataccagttccttagacaggaatacctgatcaccataaggagcgtctatcgtacctgatccaacattttgccaataaccggtataatagcttgaactaaatccaatcattccacttggatttgtcaaattaactggatactcattacctggccaattgttccagccgacaaagctgaatttttcccctagtcgtatttcttttagatatcgtgcatttgctagaaattgattcattccagcccctaaggctttgattacattggtactatcaaaatttgataaatctaaactagtccctctaaagccataaaacatgctgttcattgttgtggcttgacttgtatcaagcaaatgtagattcacgatttcatccaactctgaaggcacttttccataatggccagtgctttcaaatagtccaggaacatctgctggaagaacaacaggggcagtgagaactacttttctaatagtcatgtttgatgaaacttctgctattggaatcacttgatctaccgttgtagtaagcgtgccttctcctacagttagaactccctcaatatcaagggttgctggagcagtcccccacattccactccaaaggatattgtctgcaagagcagccttcttttcttcagttgctgctgtactgtctgtcgacgcttctgaactatttttctctgcatcttcttcagattccgttttagttgctgcaaattcttctgctgtcgcttgctcttcagattctattgcttctgactctgttcctacagtttcctcgactactttttctacttcttgctgttcaggcaacaactcccccgcagtaagcattgtttcttctgctgctgtagtgctaatttgatgcagctgatgcaggaatactaaaaagtgcttgtgtaaaaatcgggctgcctaatataaatacagaggaactgacaagaatacgtgatacgatttcttgcttcttcgatcttctcattatttttccttctttctatctaagtgaatgaacacagtctcgttctatccaatgcaaaaaagctgtcaactgacaactacttcagacatattttaatactcctgttgtcctcattccttaagtatgtattatcacatggctctgagtagcgaacacgacaacatctgctctaaaaaagacaagattcgtcctgtttaaaaaaaataattaaaatcctttggaaattatgacaaaaaagaaaataatcacattcatatcagtatttcaacggattatgcgaaaagattttgaacatggaagatctctttttattcctaatcattcacttagagaaaagacaaaaaaaccgcaatacaagcgtttgagcaaatcaactgtctcaacgataaaaggacttgcccacttgcgcagcattgcatcaaaaatatcgtttagagttgttttcactgtcacttatattgcagtcataaaaatggataagcagtcatacttgcagccacgtgttttgggtctgctaagtattcgcttgttgatcttgaacatttgatttagtcaagttcacaccttagctgttgatactgccaattcgaaaaagatcgtcactagcagatacggatatctaacgttatctgtaatgattctatagtgaggtatttgtccctgtttcttgaatagactcattaatagactcattttggaacttttcgatcgcctcgactaattcaagccagcgatctccggtggggaaactattccatttaaagaaacgtacttcgcgattttgattaataaagtattgacgatcgacaggataatccatcacgacaaaatccggcttttctgatacaaaagaaagagtatatccaaaccatcgttttaatcgctctttttgcctaatttcctgaatttttccaaattttgattcatgaaaaacccgcacagttgaccgatcaattctagctacaatcgaaagaagcatactgtactgaaaaagcaggtggttatttgagacatacagcgtactaaaaatcgatgattgttctgataacgattggtacatctcttgaaccagtggaaatagtttagggaatactcttcgataatctttgtctgttgttgtttttccaaaagcatcaatcttatttttagaagcaaacatgagagaggttgaatggatgttcaatgcattgacaaaaagatacgttgtagcactatcaggaacaagaaaagcttgtttcgctgtttccgaaaaaagtttagcggcttgtaagctctcttctgaaaaatgatttgtcatcgtcaactctgtagggatctcatcaggtaaataggtggtcattactgaaaacatataatacaagaagatatactcattttctgaagtttcatttaacaaataattatctcttaagaggggcattataagctcctttttgaattgctcaaaaggaatagtgagatggcatgtttctgtcattcccggtggaatttctttcaaagcaaatcctctctttaaacgatagagacttaaagccagtaattggataaacttttcttgatcgattcctcggtaacaacttggatacatcgcgagtctttctttgaaaccagtaatacttttttgagtcaggccaaaataacgtacatctgagccatcaaaaatttgccaatacatgatatgaaaaaaatgcctaatacgatattcttctcctacaaataacggcttcctctttaaattcaacgaaatattataattttcaaggatatccatgatctccttgagttttctttgaaccgtgcgattactcacaaaatgctgttgcgctgtattctccaaggataaatatttctctctgaataatcggtccaatatttgaaaaggcatgctttcttctaacatgacagaatataacttagaaagtaaaaaatttgaggcaaatcgaagtgaaatggttcttccgtcaattatttcgatatcataaaagggataccgttctctcaaatccagtgcacggtcaataactaaaacaattcttcttttcgaaacacttaatttatttgccaagtcgcttatactttcatattcctcagcattttcaaaaaaataagcaaatacttcatagacatcttgatctaatttagttaaaagaaacttatacatgccctcacctcttaacctcttactttaaataaattatacctcttctaccttctaatatcattgattgtgcattaatccataatgtttttgatttttttgataattatttaaatttctacttaaatagccagcctatttcattttgtctcataagtgtcccttctctttctcctcctattgatctgcataatcaacttccttcaatgctgcgttacaatccagtgtcttaatcagtaacttttcaatgattgaatatgaaaaaagatatattctataggattttcatctagaacattactgtatgatacaagtgccattttttaacataaaagtgatttttactaaagaaaaattgaatgactagatgatacagtcaaactagcaaacattcaaatacaaaacaaaaatgaagtgtccagaaagctgttatttcttaggtactttattgtttgaactgaaaattaggcttttatacaaaaaacatcaaagctaatgaatacactttgatgttcataaaacagttttaggataacttattaacgaattatctgagtatcctcgtatcatcagtaagaaattctctagatacattggttaaagttctattactcatttctttgataattgactaacggacccagacatgagatgcccaaggttcgcttttattttttcttccggccagtcccaccaacggaccttttgtaaatactgaatcgtttcatcattaaatctttttctgattggtttcgcaggaacgcctcctacaatggtatatggcggtacatctttcgtgactacagctctagtacctataatgacgccgtctccaatcgttacgcctgccaggatcagtgactcatacccgatccagacatcattgccaatcacaatatcgcctttattgtcccatgcagcagccacatcggctttatcaagaccccactcttcaaaaaatagcggaaatgtatacttggaacgcttgataatgagtggtttgcagcattaaacagaaactttgatccacaagcaatggaacaaaatttgccaataatcaatttgtcatgattgattgggtattgatacagcacattattcctttcaaactcgcgtggatcatttacaaaatcattataaatcgtgtattctccaacgctaatatttgggttagtgatggcattctttagatagatcgtttgtgtatcattggttcttgggtaaattttatttcgtgaagtagtcataatattcttctccttttggtgtgttaacgtttgactatttcacatactacaatgcactttttcatttttttacctcttctcaatttatgtacgtaatgaatatatctaaataatagtacttgaaatagtaagcagctgaagaaaaaaccgctactaacatggtatttcattcaactgctacgaatacgggacacttcaaaatcaatgtgcttaccacaatttaaatcaaataaattatagccattgtatactcataaaaaaacttacaccaacagttaaaataaaacaaggatatttaaataaaaaagacaggatcctttttattcatttgtgttctccagaaactatatacgattctttttttgaacgttacaaagaactaaccactaaaaactattgggcaaattgggcaaaaaatcagtcttttcatgactataacggaacaggcaaggagacaatatatagctcgactactaatagtactatgcatgcgaataacataagattttctcgacgatcatggtttggatgaagataggcttctgattttggtctatctttaatatcatcttgtctaacttttcttctaatcaatgccacttctgaaccgaccgcccaacacaaagtgaacagaataaacagcccaaacgatagataaatttgtttaccaatagcaagatacagtagaaaaaagtcaatcagcttaatcgaaaacaaagcgactcttcgcacctttcgtccataatagatccaactataactcatgcaccctcactccttcttaaattaatcactaccttttgctttcatattttgacttaatgaaagattttctcatcgattcttagtataatttcctcaatttgtatctcaaaaaacatgattataaataaatatatactaaaaaaataaagtgtccataaaaaatgatatccagacactttattcatgttcttactataaataatacacttaatttgataggttcttttttcgtttactgattctatacgataagagaattagtagggttcctaaaatcaccaacattgattgtcccaacgtttcttctcccgtagctggcaaagtccctctagaatcattctctttttcattatttttatgaagaacactatagacatacaccacttcctgcgcttcctcgctgaaaattccagaagcattatctggtatctctactacataccagcctgggatctctttggcttcactggcatatggtaacccgacttttccacttaagacagttggctctgctaattgatttccttcactatcttggtatttcacagtcactggtgccgcatcactgcgttcgtatacatacaccacttcctgcgcttcctcactgaaaattccataggcattatctggcgtctctactacataccaaccaggaatctctttggcttcactggcatatggtaacccgacttttccacttaagatagttggctctgctaattgatttccttcannnnnnnnnnncgccgccatcgttcgtcctgagccaggatcaaactctcataatgatttgtttgaacgatccataggatcgttaagctcaaataaaattaactttgctagctattgcttgcatgtattttgcttcatataatgaagcgccctacacattggttcgtttgcttgctttgttcagttttcaaaggtctactgcgctgcgttagcaacttttaaatcatatcagaccgacaagtgaatgtcaactcttttttaaaagtttttttcgaaagtgtttattcaacaacttcctgtgcgtcatcagcgactccattagaataacaaatgaattgttatttgtcaacaacttttttcaatcttttttgttgctgcatcagcatcaaattgattttttaaatttgcgacttcgttataatatcatctgtttccgttttggtcaagcccttttttaaaaaagtttttttgaaaggttttgactgtcggcgtgttttgccaacgttcactactttatcattaagcgtatgaaagagcaagtgtttttctgaaatactttcaattatttttgaaaaagaaaaactgcctaaaataggcagtttaatcaatgtcccgagtccgaaaacgaatctgatcgttttcatcacgtctcaagactgtttcttctttcaaataactaaaggatctctccttgagctcaggattttccaacatttcttcatatcctgtgaatatgtcttggatatactttttataggcttttttctttttgatacgttttttcattcggcaccgtcctttacgtgctctatcttagcaattgtggcagaagttgacaaccgaatttttacgattcgctagagtttttggtcgaaattttattttggggcaatataactgacactttgcgaataagcaagctcattgggaatgattcgataagaaatcgttttgccatcaataacgttgccctctgatattaaaatgccatctttgccaaccgcttccacaaaggcgacatgtccatattgtgtgctagagccagcagtgcctgggctaaaacttatcagatagcctgcttttggagtagccgccgttttatagcctaaacgttttgcggttgctccccattctccaccattccccatatattcatccacactgccgcccaattgcttgacccgattgtaagcataccaagtacattgtccgactggataagaacctgaggtattataatttacaccgttataatcaggaaacaccaacagctgccgatactctttgggaatcgcttcttttgattgtaggacaacgccgctgccagctttggcttcatcatatttcgttaattcatagacagcaatcaatgaattcagtttattgttgtagctcgtatccgttgcataacgcccctttaaatattcagtcgcttgcaggtagttttttgcttcagaacgccaaacctttttgtaaaaatcagcattcccactaattcctgtccgcagtaaatgaacataatcctttaacgactccttgtatcctgtataggcacgaaaagcagcttggatcgtataaaattctccggtcccattatcctcagctgtcatcatagaaacggaacgactaccggaagttcctttgattccaaacaaattataatacggaggagaagcaaggccactctgaccagatccgctttccaaaattgcctgtccaatcataaccgacgcatacacaccataagttaagcctagttcccgagcatcttctgcaattgccgcaacaaatgcttctgtttgcggattcttgcgaaaatcatagctagccgcatacttagcgattagtgattgtccatgaggtgttactttttgcgagtcagaaaaatgaactactacatctggtttgtttacctgatcttcttggatcaattgttttgtttccgcagtactattctgtttatcagtaatagtataaatgcgtacgccattgttttctgtcgccgctttttcttccttgactatttgttccgcttggggttgatctgccatgatcagtttatcctgtccaaggtaaattgctgctttgactaattgctgaccgtctttccaaaacaaaagatctccaggtacggctttttcaagtgatgtttgctttcctacccggctgagctgattataagtttcgatcccttttatatcaaaaacgccatgataaacagcaataggcaacgaaagattattaaatccagtaccctgcgcatctttttcatatggtttgcctagttgattcaacgcttctgaaatcagcgctgcggatcgttcatttgctaactgattcaacaacggcaagatatagccattcaaattagaatcagttggggtggtaaccaatttatctgataaatcaactgtctgggaagaatctgctataggctgattggatggcggcaattggctgactgaagaacctgtgttggatgtctttggttccgaagaactttgggtggaatttgctgtcgtatcatttggctttgatgaatgactggttcctgatggcctttcggtagtagaagacatactaggcgttgttgaatccttagttgaatccgttgtcgacgcactgctacttgaggaagatgtctcactttcagacgtacttgtactttcacttgtttcctcagtcgtttcactagaagacgatggttcagtagaatgactttcatcaatggattcttctgtttccatactttgactgcttgatgcggtttcgaaagaatcggccgttcggtcttcagatggttctgaggattcatttgattcgtctgagattgatgagcctgaatcgactattgctgattctgcgttattctctaagacagtcaatgcttcaaccgtaggcaccccttgtccaagggtgatcaatagagccgctagcattgccaacgccttacgcatactttttctttttttcattggattctcctacattgtttactcaaatcaactttaccatatgcacaatattaaaataaagtgataactctctatttttatacatttaattaatttcgtctattcggaataaaaataaacaaaaagatagcaagccctgcataataaagctacgcaaaacttgctatctttctttccgtcatgatcaatctttcaaaaaacatcttatttatgagctaaacacgctgcccaaattcgacctgaacccgctaagggaattaaggaattagtatggctcagccattccgcttatggtctggcaattacagcagatattactatattcacccaatcaattagattaatttctgataggccagtcgttcaccgtgtggaatagggaaaacaacttgcccacgatattgataaccacaggtttcgatcactttctgcattccaatatttgcttgataggtatcaatccgtaaatcatggatcccttttgctaacgcttcttcctctagcgcttttagtaaatgtgcactcaattgtttgcctctaaaatggtcactgactacgacacgatggattgatgcataaggcccatcccctgaccaactaccttcgattatcgcagtataaacgggatcgacccctttgactaaagcggcagaagcagcaatttgatcgtcatataacaagagataactttcttgttgattgatatcttctttgattttttcacgagtgggaccatagccattttgccattgaggtgagccctgtttttttaaggattgtatgcccatctcaaagagagccatcatttccggcaaatcagagagcgtcgcttttctaaactggatcatgccattcctccttcagtagcaatttgctaatcggctacaatgagcgaagtttaccgcggaattcatcgatcgatgtgtagcctttggcagtcataatttctgtcaattcttttttcagacgggcaaaaatcgctggtccctctttttgtaattccgttccgatttgtaacatcgtcgctccgcataacaaatgctcaaatgcatcttgtccagaacgaatgccgccagttccgattacattgatttctggttttagtcgggtcgcgaaagcccgaacattggcgagtgctgttggtttgacatactcgccaccgataccgccaaagccttctttaggcttgatcactactacttctgtttctgggtctatatatagaccattaccaatactattgatagaattgatgtatgttaaagggaatttattcaaaatttcagccatttgatcaaagtgcgccaggtcaaaataaggcggtaatttcacgcctaaaggcttcgtgaagaaactaaaaacttgctctaaaatttgttctgtcaatggaaaatcataagcaacttgtggctttcctgggacattcgggcaagaaagattcaactctgtgataccacgaaagttgctagcttcaatctttcttagaagttcaatattttcttcaacactcatgcctgcaacagaaaagaagaaaggtgcttcaggagcgattgcttcttgtttctctaaagcaaaattcaaataatagtctaagcctttatttggtaatcccattgaattgatacttcctaaagcgagatccacatatctcggttcgggatttccttctcgcggtgctaaagtggcactttttgtaacaaaagaaccggcttctgatgctgcaagttcctccaaatccgtagtggtcatacagtgaacgccggaagcattcataaagggattgtcgtaggtaaattcaccaaatttagtcgttaacattgttcgtctcctttcttcattgaaaatagtttacctttctagtttgcaaaatgcaattgccgttttaggtttcgtcattattttatttgtagcaattctctattcgctgagatccttgaaaaaaagacaatcagtcttcatcaaattaccgctcaaaattcttttacaatttaggtacgtaccctcttttagagccgctcgatcaattctctttgcatttttcctagtgtgactattttctttagtatgcgaaaacgccattttttattttggactgtaaaacgccaaacaacgtctaacccattgaacccttgacttaattgctcattgactagatcttttctggtgtaagccatgtgatcaatgacttttgtttgaaaaaagttcaaaaataaaatgattacttggcgatcattcacaagtaaaatcgttttgctgcttatactttctatactttgtgattcggcaaaaccaatactcatatctccttcattatagggagccgctaggcgagagagttttttctttgttaatagcataggccggattccttttctttagttatcgatcattattttatcattttttacaaaaatggtctctgaaacgacaagcagtcgtcgcacgaaaatcgttcatttcgctaaattcagactcacttttcttttactataaagcttcctgtttaacagaggtatggggtcgcgtttccttattgaaaatgcaacagatactaataaaaaattgtttaactaaaaaactcctttactaacttatcttaaaagttaataaaagagttccaaaatttctacggattatttagagaataaaatgtacttatacatccatactatttcaaacgacttacgaaactaacagccgctgcattggaatcagcaaatcccctagcgaatccccaacgcgatccgtgcataacggctcattttatcggtcgtccaagcgggataccagactaattttacttctggatttttgacttctggaatatcgcttagtgcttcgtgaatttgttcggtcaaaacgtcggctaatgggcaacccatagtggtcaatgtcattttaataactgtatcgcctgtttccccgtcaaattcgatttcatatattaaaccaagattgacaatgtcaatccctaattctgggtcaataactgtttctaacgctgctaagacacgttctttgattgcttcgctttctgcttcagtataaggcatagtcgaaacctcctttgatgatctgttcaaatcataacttgttttaatccctttgtaaatgacacttttgctttcgttttccttagggacgattctttttgttaactttcaattctggaaagactccggttgttttgaatgtacgctgttcatcgtctgttgcaaaacgtcctgtgatcgattgagtcggaacaaagttgataaatgcattctcatccgcttctaaaacagcttgttccaaatcatagatttcataacgagtaactaccatcataatcatatttccaggaacaccagaataccctcctacagatggcaacaatgtcataccgcgaaacacatgttttgaaatattcttgccgacagattccgctttggtggtgatgatcaatgccgtaactttttgatggcttgtatgaagcatatccaccacataactcatagcaaaaatggaaatgatcgtgtacaaggcgctctcccatgagaaaataaaccctgacagcataacaataatgccattaagcataaacatatatttgccgacagtcttacctgtcgtttttgataaaatcaatgagaggatgtccattcctcccgttgtgaaacccatttttaacgaataagcgactccaacaccaagtaatacgccgccaatcaacgaattcacgaggatattgtttgtgatttctccttgaggcaaaatcatcgttattaaagagaccactacaacgttaataaaactcatccaagtggaagctttgcctagtttgataaagcctaaaataaagattggcacattcaaaagcaaaataaagagaccggtactaagatgcaagccgaattgttcccacccgactgctacgatcaactgggcaacaccattcatccctgcagaaagtacttttgcaggaatcaaaaagaaattcaacgcgatcgctgcggtcaatcctgacaacaaaataaccccgatttttttcagtctttccgactgctgatgtttcgtccataatttactcacaatgccatttctccttcacaaaaaatctccttccaaagaatagcagtttgtgtctaaaattgaaactattatttgcaaaaatttagtttctctcccctcttttttctgactcatggtaaaattaaagaaaaatagaaaggatgatcttttgtggcaaaagaagcaagtttcgatgttgtatctgaaatcaatacagaagaagtaaaaaatgccatccaactagcagaaaaagaattaaagaatcgatttgactttaaaggttcgacagttgaaattaaaatggatggcaataaattaacaatcgtgggagacgatgaattcaaacttgaacaaatcaaagatgtgttaagcagcaaactcatcaaacgaagtgttccgacaaaaaatatccaattctcacagactgaacatgcacttggcgccaaagcccgtcagactgcagaattgatcaacggcattgataaagaacaggcgaaaaaaattacgaccgccatcaaaaatgcaaaattgaaagttaaaacgcagattcaagacaatcagattcgtgtcactggtaaaagccgtgacgatttacaaaaagtcatccagctgctgcgcaagcttgaattaccgatcgatttacaattcacaaattatcgttgacttctctctgtaccgatcgcaaaccgcatgtacggtctacgatcggtgctgagagtctttttgtttttgccagaaatggtccattgctttgctaatctgctctggtcgaaagcaggtttgggcgtgttgccagtgtaatggaaacagttgctggtaagccgttgtatgaaaacgctgatccagcaacaggatcacgccttgatccctagaatcacgaatgacacgtcccgctgcttgcagaactttgttcattccaggcagccgataggcataggcaaaaccagcatgttttttttcttcataatagtcccgaatcagttcttgttcgtgattgatttgcggcaatccgacaccaacaatcgccgttccgatcagacgagttcccttcaagtcgatgccttccgaaaaaattccgcccaatacgcaaaatcctatcaacgaagttttttcttcagcgtccgccgtgtcgtatttgaattccgctaaaaaattttctcgttccgtttcattcatagctgtatcctgtacgagcatcttaatagtcggatacgcgtgatgaaatgcttctgctacttcgtccaaatactggtaagaaggaaagaaaaccatataattgcctgactttgcgtgaaccattcgataaagggcatctacgatcgctggcagactggctgtccgttgccggtaagtcgtctggatgtaatttgcgatcaggattttttgatttgcaggatcaaatggacttggcagtctatagcgtaatgctttttctccgcctcccagcacttcctggtaataatcaagaggcgtgaaactggctgaaaacaacaagctggcttttcctttgtctaacacttgctgtagaaaaggagccggttcaatgcaaaattgacgaagagtcagctcatatcgagtgacctctactgttgtttcataatgatcgtcatagaattcagcaattttcaaaaagtgattcacttcaaaataactttgcagcaccgcttcctgagccgtatgttcagggttagctggcagccattctttcataagctcagctagctttgctaattgcttgttcatcgtttcatggggttctttttgatgatggtactcccaatgatccgtctcagcgattttttcaatcgcagagaattctttctccactttattcaatgctcgacgaagtttttgttgatccattggcaattgctttctaagatctttaaacgtgctgcgacgaatctctgctgaatacatctcttttgaacgattgacgagattatgggcttcatcgatcaagaaaaagtaatcttcttctggttcctcaaaaaagcgtcggagataaacagtcgggtcaaacagatagttataatcaccaataatgacatcacaaaacacactgacatccagcgaaagttcgaagggacagacggtatgcttttttccatacgtttcaatcacttctcgtgtgatttgattttcatgatgaagcagatcccatagcgcttcattgattcggttataatagccattcgcatatgggcaatgttccggcgtacaattccgttcatctaaaaagcaaatcttatccttggcagtgagggtcacactttttgtttcactgccgttatccgccaacttgcttaaagcatcttcagctacttggcgagtgatcgtttttgccgtcaaataaaacaaacgatcgccatccccttctcctaatacttttagtgcaggaaaaagagtcgatatggtttttccagtacctgttggcgcttcagcaaacaatcgcttgccgttttttaacgtcttataagcggcagcagccaattcccgttgcccttttcgatacgtttcgaaaggaaattttaacagttgtagtgaagtatttctaacacggcgccaattttcctgaaaaaccagccatttatgatattcattgatcaagtgggtataaaattcagtaagttcttccactgtaaaatggcgacggacgcgggtgatcagctgctccgtcgtctggtaataggttagttggacttcaatttccgtcaacttttcttcttgaaggtaaatataagcataaaccatcccttgagcaaaaaataaatcgatttgatcctcaggaagatcttcaaagtagggttctgacgttttgatctcatcgattacccaacattgtttctcttcgtcatagaataagccgtctgcacgtccttcgatagttaacttgtccttttcgatctcgctttctattttgaaaaagacttccttttgataggcatcgccggcttctttttgcaatcgtcgatggatacgagcgccttcttgagcagtatggttactgactttgcgactatcgatatcaccacggcgcaaaataaattcaacgatttttcggacagcaatttttcctttatacacgtgatcaccttctcggagctattatatcggaagcttcactgattttaaagcgaacaaaaaaagcctgcaggatttgcagtctttttcacattttcttaaaaaatgcctacaatggttacagcatatcaaaaacaacctctcttcttgcctaatgatgtgttttaattcttggcatcatcgcaatcgaaagttgtctcaatcgacttgtcactttcttgtggcatctatttctcttaaacttcttatactgttctgattttcaggcatttctcattagtatccgtcactgatccacttgaacttcatagcgcacattgttctcatcgtaggcacgattggttgcttcatcatactgaaattttaattccaacccatgggctcgtaaaaataaatattttccatcgatggaaaacgaagccccatgtaaggtcgtctcgtagatttcaaagggatcatcttttaagcgaagattcgcggaagcaaaatttttttcaaagtctgcttggatcgtttcatttctttttttgagtgccgaaccactcaacgtttcatcactgctactttctgtcataggcaagtattgtttgacgatggtcaattcttctccttgcagatcatagacaccttggctttgcggaaattgactgctttcttcttgaatcagcatcaagtcgacattctcggcatttgtggagctgagcttggtcgcagtagctgtcgtaggttcgctcgttttgattgcttgattttcttgcccacagcttgcgagtaacaagctgcaaaagaatgagcataaaactagacatactttcttattcatgttactgcctccactatttccataattaaggttttttaaattaattacagtataacagtgtattttttttacggaggtttcttagaaaatttttcgggatagttttttaaaaacgaccctatttttaatcaaactgccgttttttgcagatttttttaatctcattttctctttggtttcttccaccagcgcaagaagagccattttacgctctcttgctttttcctaaataaagagcaaaactgtgaatctttaaaaagctttttttgtttccttgaatactttaggctatactaaaagaagaaacagaggaggttaaaatatgaaaatcattggcttagtcaccggccctgttcaagagaattgttacttggtttggcaagatgggcatttattaatcattgatccgggagcagaggctgaacgaatcattgctgaaatcgaaaaaacagaagcaaagcctagtgcaatcttattgacccatactcattatgaccatatcggtgcagtggatcacttaagagactattacagtatccccgtttatgtcagtccattagaacaagattggttaggagatcctctaaaaaatctttctggtcgccatcctgacttaggcggtattactgcacgtcctgcagagcatgaattggcgttaaaagattatcaaattgacggcatctcttttcgcgttgtggcaactccgggacattccattgggagtgtcagctttatttttgatgattttgtcgtttcaggagatgccctttttaaaggcagtattggacgtacggatctaccaactggtaatttggaacaattattaacgagtatccaatctgagttgtttattctgcccaaccaattaactgtttatccagggcatggtgagccaacgacgattgaaaacgaaaaacggacaaatccattttttagataaatgtaaaaggaggaaacgatatggcaagaacagaattatatgtcgtgcgacacggtaagacaatgttcaatacattacagcgcgttcagggatggtgtgatactccattgacccgcacaggtgaacaaggaatccattatcttgggcttggtctccgggagatcgattttgtggaagcagtatccagtgatagtggtcgtgctatcgaaaccatgcgcttgatcttgggcgagcatttacgtgggcctcagattccttatcatattgataaacgaatcagagaatggtgttttgggtctttagaaggggcttatgatgcagaaatgtggggcgtcattcctcgtgtgttggatttccctgattatgacaatatgattgctagccatgtcagctttgaggctgttgccaatgcgattcatcgtgcggacacagcgaattgggccgaatccttcgatgaattgactgaacgggtcaaaaccggctttgaagacatcgcgtatcgggttgagaaaaaaggcggcggcaatgcgttagttgtgtcccatggtctaacgatcgccttcttgctgcatttgatcaataacgaaaacaacgtgcgtgtggacatcgataatggttcggttacccgactgatttatgaaaatggtgaattcacaattgcggaagtgggcaacactgaatatatcaagaaaggacttgccctttcacaagatctcctcgcttgattttcttgcaataatgaatcaacaaaagtaagagtagttttttgctgaaaagatcctcggcttgacgattttttcagcaagaaaaactgctctttttttaggaagtgtttggtattttttcctagaacaggtatactatgtaatgtatttcaccatacaagaaaggactgaacaaatgttttttgcgaattttattaaagccatccttttcgggatcattgaaggcattaccgaatggcttcccatcagtagtaccggtcacttgatccttgctgatgaatttattgggttgaaagtaagcccggaatttatggcgatgttcaacgtcgtgatccagttaggagcgattctggcggttgtttacctctatttccataaattaaaccctttttcacccaccaaaaatgcattggaaaagagagacacttggacactctggtcgaaagtgatcattgctgtcttaccatcagtcatcattggtttgccactggacgattggttagacgctcacttctataatttcctctctgtttcgatcgttctgatcatctacgggatcggcttcatcgtcgttgagaaaagaaacaaaaacaaagaaccaaaatgtaccgatttgaacaagttcacttataaagcagcactaattgtcgggatgtttcaagtattagcattgattcccggaacatcacgctctggcgctacgattcttggaggaatcatgattggtgcctcccgctttgtcgcaacagaattttcattcttcttaggtatccctaccatgttcggtgcaagtatatggaaaatatacaaatttcttaaagttggaaatgcttttgacttgcaaggaacagttatcttattaactggaacgatcgtttcctttatcgtttccgtgttagccatccgcttcttgatgaattatatcaaacgaaacgatttcactttctttggttggtatcgtatcgtacttggtgcggttttgatcgtttactggttagtatctttataataaaaacactgcgatgtccttttggacatcgcagtgtttttagctaaattacgtatttttgatgaccatgccgtcaataatatcgacagcaccttctgtgtcgttgatgattgtttcaaagcggtcataaatgtctttccatttaatgatttctaagacatctttttcatcagtgaaaagggcctttttcaatttagagtacaaaaggtccgcttcagactcgatacgattgacatcattgatcatttgtcgtagcgtctttgaatttttgaacttaggaaactcttttaatgccgtctgcacaccttgtgtggcctgttcgatcatgacagcgaaatcagctgtttccggacgtaatgacttgatcacaagattttcaaataaataagtcaatcccatgatgccatctaaaatatcgtccaagcgttcagaaataatcaaaatatcttcacgatcgatcggtgtgataaaagaatcatataattcattggtcaattctgcgatcacttgatcgccttctttttctaatgcgtgaatttctgctgctgcttcagttaacgctgcttctgaataatcatttatcagaactgagaaacgttttgccgctaaatgaccattggttgctagctgctccatcgctgcaaaataatcaaaacttttttttcgtgccattcttctctctccttacaaaatcacaagtaatacttttaccattacataggcaatcaagccacagcctgggaaagtcaagatccaagcataaatcatttctttcacgatgcgccagtcaacgctggaaaagcgacgtgatgcgccaacacccatgatggcagttgtttttgtatgtgtcgtcgaaacgggaatcccaaacacggaagataagaacaagcagattgccgctgttaagtcagccgaaaaaccttgatatttatccagtttgaccatgtccatgccgacagatttaatgattttcatcccaccgacagaggttccgattcccatagtaagagaacataacgccattacccacaaagggatcgtaaagccgttgccgcttttttctacaaggttattgtagtaaagacctagcataaagacccccataaacttttgaccgtcttgtgcgccatgcaaaaaagcgtttgctccagctgcgaccgcttgcccgatcgtaaaaactttatttgctttacgacgagaagttccccggaagagccaaacgatcaatttggtgatgataaacccaccaatgaaccccatcaatgttgagaccaccagccctatcagtactttgacccattcttgtccgtttactgcatgtaatccgcccagtgccattgctgctcctgtaagtccagcaatcaatgcatgggattcactggttggaatcccgaagtaccaagccgcaaccgtccagacgacgattgaaaaaagtgcagcagctaaagcaatttgtgcaacatgaaagccgccagcagtatcaaagctgacaatgttactgatggtttcagcaacttgcgcattgaaatacgtcatcactaagaccccaaggaaattcatcactaccgccattccaatagcgacatttggacgtaggaccctcgtagagactgcggtggcaattgcatttggagcatccgtccacccattgacgaaaataacgcctaacgagagcacgatggttataactaaagccatattcacatttatacacctcatttaaaaattccgaagtaatcatagcatagaaagtgaacaaagtgtaaactttttgtaagtattcattaaaaaatatgtaaaggattaaaataataatatagaacaagaaaaaatagctggcaaaagcacctttttttgtgttaagtaaaatttctttacaacttttattgcaaatgaaacttgcattaggtataatgactagtgttgatttatacgttttaaacgtataagaacttatttttggaggtgaaatacatgccaaacattgaatctgcaatcaaacgtgttcgcacaagcgaagcggctaatgctaagaattcatctcaagtaagcacaatgcgtacagcaatcaaaaaatttgatctagctgttgaagctggtgctgataacgtagatgcgttatataaagatgctgttaaagcaatcgatatggctgagactaaaggattgatccacaagaacaaagctagtcgtgacaaatctcgtttaagtaaaaaaattgcgaaataagcaaattaaagccgaagcaatcaaatgattgcttcggctttcttttacccttgtcttttaccatgctttaaaacgaacaattgaaacagaaattctttatcgatttgaccacttttcaccaaataatcattctcaatcaattcatgataaagggctgctaattgcttttcattgaactttcttgcctgctgcattgctaacttgacccgatagggatggacttttagtgtctcagcaatatttgcctgttgatagccgaccttcatcagaatcgacgcttgtaaaagcaagcgtacttgtccaatcaaaattgcattgattttaatggtctcttccccttgtaacaacaaatcatcatacaaccgccaggcatccgctacttttccttgtaacacatcattagtcaattcaaaaacattgtgttctaaagtttttggaatcaattgctgaacgatttcttttgtgatcttcgcatcttttcctgcatacaagcgtaatttttgcagctcctgcatcgcttttgataaatggagatcagtcaaccgcagaaacagttcaaaagcttctctagtcatttcaataccatcgtttgtcaatgtctgttgcaagtaccgacgaacatccgcttctttcattggtgccacatcgatgatgatccctgcttttttcaactgcttcgtgattttctttcgttcatccagcttatcatattcggcaaaaatcaccaaaacagccgtgtccattggattttttaaatacagcaaaaaatcatcaaggtcatgttctggaacattggcttttttttctgctgttagaaaaaaaggccgctccacaaagatcaatcgctgatcaccgaaaaacggcaacgattgcgcttcttgaatcaccaaatccaaaggctctctttccatatcaaaagaagcaaaattcaagtcatcttttgaaacttcaaaacgcgttaaaaatgcttgacgtacttgttcttgtaaaaatttttctgtgcctgtcactaaatagataggttgcagagatttcgttcgaatctcttgcaacgctttttgcagttccatagattcccccgctttcttttccatcctatcatcattctaatcgatagtctagccatgtttctagctgttggacacgatgccaatttgaccagctgaagcggatcatcccctgctgatctgttctcaagatgcttcttccttccatcacttccaaaacttcagaatgtggatgtccatagcgattgtctttgccacaagagatgatgccgattttgggtgaaaggctctcgataaaacgagcagaagtcgaggtacgactgccatgatgccctagctttaccacttctgcctggagatgagggtacagttgaatcaacttttcttcccctttttgatctaaatcaccggtaaataaaaagcgccacttctcaatttcagccttcaaaactaaagaatcttcattttcaccttgtccagactcaggagctaaaacagtgatagcaaggtcgcgaccaatggtttcacccacttttgtccagtgaacagttccttgcggaagctgcttgattaacgcggcaatctgaggatggtgttcacttccaggaactaggtatatttttttgatagggattgctgtcattaatgccaatgcatcacctagatggtccgtgtctccatgagtcaaaaaaagcccatcgatttgcctgactccctcgccttttaaaaatggaatcaatgaggcgtgtgcattttcttgatacgcgcgttgctgccacgcctctttaggaaaagataaactgccgccggtatcaatcacatacacttcccggttaaaggctgtttgtaagacaaaactatcaccttgcccaacatcgacaaatgtaacggcagcagggacaaaaagacgctgtaaaagtagcggtaaaaacaaactgactaagaaacaaaaaaagaactgatgccgctgataaaaaaataaaccaagaagactacagaaaatagcaagttctaagggaatccttccagtcgtgagggcaaatcttccaagaaaaaagacgatttcctctattccatgaaaaagtgtttcactccaactatccagatagggtatttttggtatcaaaagacttacggcaaaaagagcaaaacagctaggtaagataaaacgttgaaacaacggaagcaaaagaagagtaaaaatcccacccaacaaaggaaattcatagaataagtgcatcagcagcggcgctgccaataacggcaaaaactgagaacggatcactgaggaaacctgtacgtttctttgcatgagcaataaaaaagtcatcaaaaaacatagctgcccggacgtttgcagaaaaacttttgggtcgatcataagtgttagaaaaagcacgataccgtaacgatcacaggctgaaaggtgacaggaaaacagtcgcaaaagaacggtcatcccataagcgagaacagctcgaatcacgctgatagaaccaccaaataaaatggcggctatcaggataattggcaaaagaggaagcagcatctcctctctggtgagctttcctcgtctcagacctcgttctaaccagtagaaaaagaaagacacatgcagtccggacacagtaaaaaagtgcagcaagccactgctactgaataattgacggatctcttgaaactcatgatctttatacccaaataacaatgcgtttatataagatgccaacttctcagggaaaaactgcttcacgtgagtcactgcagctgctcgccacctgtggatcgaagaaatcccggcagtttgtttgcttgcgagaatctcagtaatcgtcaatgtgcctaagaagttcctgctagccaaataaaatgagtaatcaaaggcatgtttgtttcggattggctctgctatcttgaaatttccatgtactcttagtgatttctgccaattttgtcggctgagccattggtctttttcggaaagagaagaaacttgataacgccccatcactttaccttcaggcagtttcccttcaaatgtcactaaatcaccattgactttgattgtatcaggatagataagaacctcagcagttaacgatccttcttccaactgaggattttgaaaactgaccatacgtccccctatcaatacactgccaagacaacaaagtgccaataaagcaacttgtttttttatcagtagtcccagaagaagataacttgcgataataaataaaagaacagatttcaaatacaaacctgttacccagcaaccaatgatcactccaacaaaaaggaaatggtcacggcatgtttgtatgtgtagccccattcaaggcaccaaaagataatttttcaaaatatgctggatcaagttcaacttggtggacggtagcaccaacttgttgaatcaaatctagagcatattgattattgcggtagtcattcagataatgaattttcttgacgcctgcctgcaaaatcgccttcgtacaaggcaaacatggaaagtgtgtcacataaatctcggcattgtcggttgaaacacctagcttggcgcattgcagtaatgcgttcatttctgcatggatcgtgcggatacaatgtccgtcaaccacatagcagccttcatcaatacaatgaacgtctccactaactgagccattgtagccgccggcaataatccgtcggtccttgactagtgtcgcccccacctctaaccgagagcatgtacttctaagagaaagtaaaacagcttgagccataaaatactgatcccaagggattcgtttatttccttctatcgatcggttttgagaattaacccattgattctttttattcagatcgcttgtcatctgcgtacctcctttttctatttttccgattgcgaaataatagtacacaattttttataatatactatacccccactgattaatctaggggctgatgaattttagtgtctttttctccattcacttctgcttgtttttcctactgctaccgtcagtcaaacagttctcaaaatgactccattacctgctgggtattatttttgattaagggactgggaataaaactgcttgttattttctttgatgctactaatatttgatgctactaatggatggaacgaaagatcctcactttactcttcccaggtataatagttttttcgccttttctctctttcttcttccgattcctccctttcattgaaacacttgcctaacgcaaatttttcataaaacctttgtagcaacaccatctgcctatttctagtttttcaggggtacataaaataatacgcctttcgagtgctcttgcttttttttaacagcaaaatacacgcttcttttttatttccagctttttttctttttcacttttgttttcagaaaaaacttggaaattttcttacccaaaaagttttatacttcgttttgtaagaaaagaggtggacacacaatgaacagaagcatacatcagctttctcctccgagataacagcgccaaaatgatattagacttagaaagaagcgatttgatgaacgagaaaaaattatttttatttggttttttcgcactaacagcctcgatggtcctgactgtgtacgagtacccaacttttgccacgtcacaacttcatttggttttcttcttattattaggaggtatcctctggtttttgcctgttgcactctgcgcggcagaaatgtcgacggtaaaaggctggcagaacggtgggatatttagttgggtcagtgaaacattaggcgaacggtttggctttgcagcgatcttctttcagtggtttcagattactgtcgggtttgttacgatgatttacttcatcttaggggcactttcttatgtgctgaattttcccgccctcaacaatgatccattgatgaagtacatcggtttgctgattattttttggctcttaacgttttctcagttaggtggaaccaaaagaacagcaaaaattgcaaaagcaggatttgttatcgggatcgtcattccctctatcctcttatttgtgcaagcagcagcttatttcatcggtggaaatcctattcaaatacctctgagtgaaaaagcatttatccctgacttttcaaaagtttctactctcgtggtatttgtttcttttattttggcttatatgggtgtggaggcctctgcttcccacattaatgaactaaaaaatccgcaaaaaaattatccactagcaatgattttgctagtcattcttgccattgcattagacgctattggcggcttctctgttgctgcggtcattccgcaaaaagaattatctctcagtgccggagtgattcaaacctttgaatcgttgttgcttcacttcaatccgcatcttggttggctagtgaagttaatcgcactaatgattgcctttggtgtcatgggtgaggtcagctcatgggtcgttggcccatcaagaggtatgtttgcagcggcacaacgaggattactgccgacttttttgcgaaagcacaacaaacatggcgtccctgttccgctaatcatgattcaaggaatcatcgtttcaatatggggtgctgttctaacgtttggcggcggtggaaacaacttatctttcttggtagctatttcgctgacagtagtgatttatttgattggttatttgctgtttttcttgggctattttgttctgctttttaagaaaaaagatcttcctcgtacctataatgttccaggaaaaacaatcggaaaaacaataatcgcaggattagggctcatcatgtcgctgctcgcattattcgtttcgttcttcccaccttcttcgattcctgccagtgaagacagaacttaccaagtcatcttgttgattagtttcatcgttactttattgttaccattcattctctatgaacttcatgacaaacgtggcaaagaagctcaaatcgacgaaccggttcatatgaaaacaggagatgtgaaccctgccacttatccaagcgctcgaggagaacaccacatcgttcaaaacgagaagtatacaatcaaacattaaccgtattttttatctattaggaggaattatcatgttatatggaaaagaaaaccgcgaagaagcagactatttggaaccaatttttggagctgtttgtgaaggagaagatttaccgaaatacaaactaaattcacaatctgttgaacctagaatggcttatcagctcgtacaagatcagctacttgatgaaggaaatgcccgtttgaatttagctacattctgtcaaacctacatggaaccggaagcagttaagctgatgacacaaactctagaaaaaaatgccatcgacaaatccgagtatccacgaacagcagaaattgaaaatcgctgtgtgaatatcattgcagatttgtggcatgcaagcaaagaagaaaaattcatgggcacttctaccattggttcttcagaagcctgtatgttaggtgggatggcaatgaaatttgcttggcgtaatcgggcggaaaaactcggtctcgatctaaatgctcataaacctaatttagtgatttcaagcggttatcaagtttgttgggaaaaattctgtgtctactgggatatcgagatgagagaagtccccatggatgaaaaccatttgtcgatcaatcttgataaagtgatggactatgttgatgaatatacgatcggcatcgttggcattctgggaatcacctatacaggacgctatgacgacattaaaggattgaatgaacttgttgaacaatacaaccaaacaacggactataaagtctacattcatgtggatgctgcttctggtggtctctataccccttttactgaaccggatctcgtctgggactttcaattaccaaatgtcatatcaatcaacacgtccggtcataaatacggtctcgtttatccgggtgtgggctgggtactttggcgcgatcaatcttacttgcctcaagaacttgtatttaaagtcagctatttaggcggtgagttaccaaccatggccatcaacttctcccatagtgctgctcagttgatcggacaatactataattttgtgcgctatggttttgatggttacaaagcgattcatgacaagacccataaagttgctctttatttggcaaaagaaatcgaaaaaaccggtctattcgaaatgatcaatgatggcgctcaacttccgatcgtctgctacaaattgaaagacgattcaaaacgggaatggacgttgtatgacttagcagaccgtttactcatgaaaggttggcaagttccagcttatccattaccagccaatttagacgaccaaatcatccaacgattggtcattcgtgcagactttggtatgaatatggcccacgattatattcaagacatgaaagaagctctgctggcacttgatcaggctcatctggtctatcataaaaaacaagaaatcaaaacctacggctttactcattaaaaaggccaacacgttctagcaagaaacttccccaaaatcattagagctctcaacgttacttctattgcggaactgtcccaagtagtgccattcgcttgcactactttagttcaaagagagggattgcgcacggctgtgcgcaatccctctctttgtatcaataattatctttttcagtcttttcaattactctttgttgcaaagatttcctcgactcgttgatatagtgtctgattgatagctaagataacagaggaaacagtgttgaaagtcaccggataaattttagtatttttcgtttgaagtgtttcttgataaagagaagcatcacataaaatcattcgtttggtacaaaaaaagacatcatccaccacatcagttaattggtgatagatcatattgcttatggtaaagtgctcatctaacatttcttctaactgttggcgataatacaagtatttaaaatcagaaggtgcaacaatatacacttccaaatgttcagttttttcagcatcaggaagcaaacttagtaaaatcgtcaatttacgaaccagattgtcattccatcgaatcatctgctggttttggtttgcccataacccaaggctctccattatttgatcaaacatttccctctcacttgggtagagaaagaatagacgatccgtttgaaagatctgcatgtccccccaagcggaacgaagaaacggtagtaacgctttttcgaacaacaaatgatttttctcggagattcctaatcggttttgtaataaatgcgtgagttccaacatctccggacagcgatgaatgtgattacgataaacgacttcaaaatctctttgcaacagctccagattattgcactgatacttgcgtgaattaaaaagtgaatagatgtaaaattcttcgtcctcattgctacacaaagaaactacaagttctttaagaccttgctgtaataattgaaatagcggtgtctgtcgtgccatctccttgtcccttgatgcaaaacaaataggagctattcggcttcttgctaatccgatgtggatccctaaatgaatgatttgacgttcgtcttcaggataagaacgcagaaaaaaacgttgttccacgaattggatcagttcttcacaagcctgctcaataaaagactgatttttttcaggacgttttcctaaatagttcattacagccaatagaagatagcggaagtctttctcggggatctcgacctcctcttgctcttcatttaaatagcccatttcctcaaaaaatctccataagtctgtccgaatggtataaaccttgcttaatgaaataaacacctcttccgatattttttgccaacttctctctccaatcaaaaattgatagagaacttgtaaaaaataggatccttgataaatggtttgagtaagctctgataaggaagatccggcagtaaaaaccacttgatatgtatgcttctcgtgagtggcggtagcaatgcgttcttttagtaaaagcagaattttatcaatgtcattgataatggtcgcaggacagacatccagctgttcggctaaacggtcaataagcacgctttccttctcatacaactgctcgcaaagatagacttgacgaatcacgcatttttctatatacctttccagcataggctcgctcctttcccgaatttattacgtccgttattataaactatcaggaaataggaagaaatgaaattgatagcattctgaggaaaagtttaggcaaaaaaattgttttcaaaattatttttaattttatcttgggaaaaatgaagaatttttcatgtaatcggtatagcttacctttagcaaatcttttcctgctgaaataaacaaatggattacacagtgagaaaaggtctactttgtattcacacgataaattccttagatcccctagcattcgatacaacatatagttgtatcgattgactctttttgagcaaaagattaatttttacaaccaccggccgcctgcgacagagtgtgtttttgttagcataatacgtcgcgatactgacttgtttcacccgatcgctctactaaataaaaatgacttctctacttaccttataccccttatacccctatactccctataccccctacaacaacgaaacagaaaagccactgaatcgcgagcttattctcttattctttctcttatttttcatcgcaccttgatcaacccctccaaagcctcataagttttagggccaataccagaaacttctttcacttcttccacggttttaaaaaaacccttttcttcacggtaagcgatgattgcctctgcctttttcgcgccaatgcctggaagctcttgtaactggctgctatctgctgtatttaaatcgatctggttctgagcaagtgttccttctgctccgttgtcagcgtaaactaccggatcatctaaatgaggaacgattactaattgttgatctgacaattcttgggcaaaattcatgacttcttcatttccttcatcagtgaccccgcccgctaattggatcagctcatacagtcgagctccactaggtaaggtgtaaatacccggatttcggatttctcctttgatatctacaacgatctggtccaatgactctttcctactctctgattcgaaaattggtgaagattcttctgcttcgggccattctggctcattcggggtaaaaaacaaaccaaatagaaaaagaatgaccaacagcgcgctcaaggataaatgccaatattttttcccaaaatccaaccacttgtccataatgaatcacctcaaaaagaagtacgcaaaaaaagtcttgattgctcaagacttgataatttcttcgatttctttcatggaatgaacgacatggtctgcatccaaatcagttagcaatccttcaatatcatagaacatcgtttgcacccctgcccctcgtccagccagcacatccatcgcacgatcaccgatcattacagtcgttgttttgtccaattgatatttttccactaaataattcaaagacgttgggtccggcttgcggggaaaattattctccggtcccacgatctctacgatcaaatggtcaagattttctttcattaaaagttctttcgttgaaacaacgtcacgatgggtcaaaatataattctttccaccatggtctactactgcttgtaaagcttctttcgttcccggaaatgaaacgggtagccgctcatctagtgcttcatatgctttaaaacgagcgctaaaatcaatgaaatccaattgatatttctcagctacttgttttgatgacgatgctttcaagatgcgataaatttctctcgaatcgggatcaaatccagcgtctttcaatgttttaagaaacgcctctaacatgattgggtaactgtcaaacaatgtgccgtcaaagtcccaaatatacgaatgatacatgtacaaccctcattttctaaaaataagctgaaatgtttccgtgaaaaaaatgttttttcagcaactttacaaagtttatcacaaaagtccgcctttgtctttagatcaaaaggcaaagtggttgagacagaagtgattagttgcaagaaattacggcttattactgcaaaagcgaccgcttaccgtgcgttcgaaaaaagagctatgacaaccttttgtcacagcccttaaaaattaccagcttccggaaattccgcccccactactggacccaccgccaaagccaccgaaatcactatccgagcttttactctctgcgatgacctgttcttgtcgcgtgacatgattgatgagtaacaaataaactaaagattgatccatagtggttggattgtattcacgacgagcattattcaatagttctgaacgatcttcccccgaaaaatcacctacttgtttttgtagatctggatgatttttatatacttcatggagatcgatagtaaacaaagcatccgttttaacagaatcaatcaagctagctatttcctgagaactcgtctgcaccatttcaggatacgtcttttccttcgtaagcagcatagccaaataatcgttgttgagactacgccgctgaatttcttcttccgccaactgctgaatctcttttttatactgtggaatcaaataagcattttctgcaagaatatctccagttaaatcataatctcgtaattgttccttgagttgccgctgcaattgtgtttcataggttcgcaatgtgtcatggccttgggctaactcttgcccaaagatcttcaaatttttatgatctttcatatattcttgcacgaattgatcggccaactgcggatttttcaatgcttgttgaatcatttggtttctagctggttgcggactgattctttcaaactcagctaattgcctcggaataacttcactaagcaggtacatttttaaagccttcaaacactctccagcaacaatatagtgattgaaggtctgataattccttcttttacttgcccatctgtaaaaagccttttcatcaaacgctggatccgaatgaatatgaggaggaatcacattggctgcttgaaaacttttcttcgtttggcgcttgcgccagcctatcactccgctaatagctgcaataatcaatgcactaactgaactaacaagttgccaaaacagcaaccagaatttctttgactctgcggcttctcgggcctttttttctgccagtagctgttgcccatccgcataaattttgttcagaccaaccgtttcgtccgctgttttcatttcctcatagacgcgatcagaagcatttaaaacagcttgatcatagtcttcatcacgcaaaagaacttttgtatcttcatcgatcaggtcatcatctgacaaatcagaaaaaatatacgttaagccatccccatagcctaaacgaaattcccggtcctcgatggcaaacacaaagactaagccattgttatacgcggattgaccaaaactgtattcatcaaataactgattggttactgtctcgatcgtttggccgtctaagtttttaagcgtgacaacagcgtattctggacttcctggcaacgtttggaacctctcttggtttaattgattgatttttgcgattgtctctgctgagaggacccctgcattatccttcacaaaactttgaccaaatactttttggggaacaagtagcacgaacatgacgatcactaccagtatggagctgcccactaccctctttttcattcttgacacccctatctgtataaaattacgttaattgtatattatttccagatgatcagcatagggctaaagccttagatcacaaagaagaaactgcgaactaagtgctacactaaacaaaatgtccgatttttttactagcatcccctccaaaataccattaggtctttatgagcgaatgttcgaaaagtaatcaccttttcgtccaatcgagagcatttgattttgtgtgttccttatatcgcagtttcagaagatgatcagtttttgaaagaatgaatcggcgcaggaattcggccgcctcgctgaataaagtcagcagatttagctggattaactttcataacaggtgctgtgcctagtaaaccaccaaattcgattcggtctcctacttgtttttctttagccggaatgatacgtaccgccgttgttttatggttgatgacgccgattgctgcttcatcagcaatcatcgcagcaatcgtttctgcagtagtatctccaggaattgcgatcatgtctaagcccaccgagcaaattgctgtcatcgcttctaacttttctagattcaacaaaccactttcaactgctttgatcatgcctgcatcttctgaaaccgggatgaaagcacccgataaaccaccaacgtgattgcaggccatgacgccgccttttttgacggcgtcgttcaacaacgccaatgcagccgttgtcccgtgagttccaacggattccagacccatttcttccaagatgagcgccacactatcccctacagccggagtaggtgctaaagaaagatcgacgatcccaaaaggaacccctaaacgctctgaagctacccgtccgacgagttgccccatacgggttattttgaaagccgtttttttgactgtttctgcaacgacgtcaaaagattctcctttgactttttcaagcgcacgcttgaccactccaggaccgctgacgcctacattaatctcgacatctgcttctccgacaccgtgaaaagcaccggccataaacgggttgtcttccactgcgtttgcaaaaacaactaatttcgcacatcccatatctgaagcttcagccgtttgtttgactgtttcccccattaaccgaacagcatccatattgattccagctttggttgatccaatattgaccgaagaacagacaaagttcgttgctgccagcgcttctggaatcgattggatcaatgctaaatcaccgccttgataccctttttcaaccagagcactgtagccaccgatgaaattgacccctactgtctcagctgcccgatccaatgttttagctaccttcacacagtcttgtggcgtcggttgactggctgccacaacaatggcaatcggggtaacagagattcgtttgttgatgattggaataccatattctgtttcgatttgttcgccaactcgcaccaagttcttggcttttgtcgtaattttttgatagattttttcgcacatctgatcgatatcggcatcaatacagtctaaaagagagattcccattgtaatggtacgaatatcaagattttcttcttcaaccatgcgaatggtttctagtatttgattgatttccatagaagccctcctataatttatgcatggtatcaaaaatttcttggttttgaatactgattttaacacctagtgtttcgcctttggtatgcaattgctcacgaatcgtttcaaaatctgcatttgcctccatcgataataacatcatcatcgtaaagtattcttccatgatggtttgtgaaacatcgaggatattgatgtctaattctgccaatagttggctgacgcctgcgatgatccctaccttgtcttttccaataacggtcaatactgctttcataagagcccgcctttcataaaatttttcttattatagcataagaaaaccgcactttcgatgaaacttcatacgaaagcgcggtttttagtaataatgttcgtctttatcccagtcgttcttgtaaaacagcttgtgaatcaaaggtataaatgattggctctgcattggggacatcgattttgtcgacttcttcttcaggtacattctccaaatacttcactaaagcccgcaaactattgccatggcctgtgatcaagacattttttcctgatcgaatgaagggaacaacatcatccgaccaaaaaggggtgatcctttcaacgaccattcctaggttttctcctttaggaatcaagcgtggatctaagtcgtcataacgacgatcaaaatgattttctgaaacatacagcggcggttcattataccctcgtcgccacttttggacttgatcttttccataccgagcaaccatttcatctttattgacaccgactaactgtccgtagtgtcgttcattcaaccgccatgtcttataggtaggtacccacaattgagcgcttgcttccaaaacagtgttgcaggtgatgatggttcgctgaagataagaagcaaatgctacatcaaaagaaatacccaattctttgattttttctcccgcttgccaagcttgttcccgaccctttgctgtcaaggccacatccagccagcccgtccaatagttttcaaaatttgcttcgctttcgccatgccgtatcaatactaccttcacttgaacgcctcctctttgattcattatctcaagaaaaaagcaaaatgtcttgggcaaagttcatagaggcatccttttttatctgagtatacaaaaaggctaggcataagttgagccagacccgatctttaaggaacaactgtcctctcgaaaatctttctgactgtttttacttatgccctagcctcatacgtgcatgggtctgttcttaaaatttggagaaattaatcaagaatcgttacttgaacggtccgacggccccattgttcgcattgtgcattagttgggaaatgcacgtcgatgatatttcccttgatcgcaccaccggtatcgctggcgatggcttctccatacccttcaacataaagtcttgtgcctagagggattacagatgggtccaccgcaactgccatcggattttccaacaagttttggccggtagctgtcacagttccgccgcctaaaacatctgctggatcagaactatatgctgttgcttccatcgtcatcgttgttccagaatagctgcttgctgcagattcagattggttttcgttggcagattggtcttctgcttgtgtggtttcttttgcaggttgttcacttgcttggttatctgatgatacttttttgtcggtgtcaataatcagagttgtaccatcgtagatgatgttaggatctttcagtttgttgtcttttgcaatttgatcaatatgatctaaattaccaaagtattttaaagaaagaccagataatgtgtcatcagatttcaccacgtgtttgatttcgtctgcgttagcagttgtacttaatgcagcaaaaccagcaattgtggctgtagttaatacgaatgttttaattgatttcataaattttatttccctcgctctatgtaagttttcgtcgtaacgacttgataaataatagcaagatacgttaagtccttggtaacagttcgatgacgaaatatttcactttgataaaagaaattaaataacgtaccaaataaaaaatagaaagacttaaaaccttgctaaataaggctttaatagtaaacataagatcgattaactgttacaagtttcttttaagctaatcaaaaaagccgaatgaatcttaaatattttcataatttccggaaattttctgaaataaattttcttatattacaaatttgtaaaaaacaattcaacctgtaaacttatagaaaacactgttttttctgaaaactcaaatatatttcgtgatttttccaagaaagggattgacttcccacaaaggtatgatacgatatttctaacgtttgttgtatttttatacataattcaagctattattgtattttaaaacaaaaaaaggagtaattgaatgaaaaagatgtgtaaatggttcgcttcaacaatgatactgatcgtcctgttcttttgtgttaccacaaaactggtacacgctgaaacaacagatcccgtctatgaaaaaataaaacagaatggcgcattgatcgttggcttatctgcggattatgccccctatgaatttcatgccacgattgatggcaaagacgaaattgtcggctttgatctatcaattgccaaaaaaatcgctgatgatctaggcgtcgatcttaaaattgaagaattaggtttcgatgcgctgttaggagcattaaaaactggaaaaatcgatcttgtcatttcggggatggctgctaccgatgaacgtaaaaaggaagtcaacttttctgacacttatatggaagtccaacaaaaagtgattgttcgaaaagaagatcagaaccggtttcaatcaacagcagatttcaacggtgtagctgtcggtgctcaaaaacaaaccacacaagaagaattagctaagaatgagttgtccggctcacttgtaacctctttgcaaaaagttccggatctgatcacaaatttaaactcaaaaaaagtggatgctgttgtgatggaaggtcctgtggcggaagcctatgttcaatcaaatgataacttagcaattgccgacgatgtggtctttgagaaaggtacgaaagaaacagcaattgctatttcaaaagaggcgccgctgctcctggaaaaaatcaatgcttccatcaagacgattgtcgataacgatctattgagtcaatatcaagatgaagcctatgctctaatgttcaatgaagaaacaggagcacctgaagaaggcttctttagcaaatatctgcccttttatctctcaggagccggttatactatttttttagcctttgtcggtgtactctttggctcgattgctggtagtctactggcatttatgaaactttctgcgtcaaaaattttgcgttggattgcgattgtttatattgaatacgtgagaggtaccccgctcttagtacagatctttatcgtttattttgggactggcgtactaggtctggatttatccaagttaacggcaggttgtatcgctcttgcacttaatagtgccgcctatgtggctgaaatcattcgtgcggggatcaatgcggtcaacaaaggtcagttggaggcagcccgttcattaggaatgaatcaagttcaagcgatgcgcttcattatttttccgcaagccatcaagaacattttacctgctctcggcaatgaatttgtgacagtcatcaaagagtcttctgttgtctctgtcattggtgtctccgaattgatcttccaaacaggggtcgtccaaggtgccagtttcaaacctttcctaccatacgtgattgtttccttgatttattttgtcttgacttttgctctttcacgattactaggagttgcagaaaggagaatgaaaacaagtgattagcgtaaaaaaacttttaaaaaattttggtgcgacagaagttctgaaagagatcgatcttgaaatctccgcgggtgaagtcgttgtgatcattggaccttctggaagcggcaaaagtacttttctgcgttgtttgaatcttttagaacaacctaccagtggtcaaatcgaatttgaaggaaacgatcttttggctaaagagattgtgatcgatcaaattcgtcaaaaaatgggtatggtattccaaaactttaatctgtttcctcataaaacagttttggagaacatcaccatcagccccataaaagtaaaaaaacaagatcaagagaccgctgagaaaaaagcctacgcacttttggaacaagttggattagcagacaaagcgactagctatcctgcaagtttatctggtgggcaacaacagcgagtagctattgctcgtgcgttggctatggatccagatgtgatgctttttgatgaaccgacttctgcacttgatccggagatggttggtgaagtattagcggtgatgcaggcacttgccgagaaaggcatgacgatggtcgttgtgactcatgagatgggctttgccaagcaagtagcggatcgcgtgatctttatggctgacggtgtcattcaagaacaaggaacacctgaagcgatctttgaccatccgcaaaatagccgcacacaagattttttaagaaaagtactataaaaaatggagatgaacctatgaaacagtcgatgattgcacaacgatttcaaacacccgaagaaaatttactaatggacattgcaacgattgccaagaaaacaccaaatttgatagatctgtccatcggcgatcctgatttgattactgatcagtcgatcattgctgccgcttttacggacgtcaaaaatggacatacaaaatacacggcttctgatggcagtgccgattttattcaagctgttgtcgatttttatcagacccattatggattgactttctccaacgatcaagtacgggcctcagttggtgcgttacatggcatgtatcttgctttgtgcgcgatcttggatcctggagatgaagtaattatccatgagccttacttttctccttataagcagcaagttgaaatggctggcggaagcccggttttcatccctacctttgaaaaagatggttttcagatcgctattgatgtattaaaagcagcgattaccgacaaaacaaaagccattatcattaattctcccaacaatcccactggtgctgtcttttcgccgacaacttttaaagcaattgctgaagttgccgaagaaaatgatttgttgatcttgtcagatgaagtgtacgaagccttttgttttatggaagagtttgttcctatggccacttttgcgcctgaacggacgattacttttagcagtttttcaaaagcttttgctatgactggctggcggattggttacatgatcgctcctttatccatcaatcagacagccaagttgattaatgaaagtattgcttattctgctcctaccccctcacaacgagcgggaatctatgcgttgaatcactacgacgaacttgttccagcagtcgtggaaaccttcaaaaaacggctaagttacattcagcaacgagtcgctactattccttttctttctttgtctcctgtcaaaggaagtatgtatgccttcatcaacatagaaaaaactggcttggattctgttactttcgttgaaaaacttttaaaagatactagcgtgctaatgattcccggtaaagcttttggtgagacgaccggtgatcattatgtccgtttagctgctacgcaatcaatgccaatgctaaaagaagcctttgatcgcattgagcagttcactttttaatcaacaaaaaatccctctgcagctagagtgattgaaccattcgccaaaagttagccataaaagctaacttttgggagtgattcactctcttggagcagagggatttttttattctttttttgcttcttgaatcagttttgctattgcttctttttgatattctgcagtgaattgactgatttttgctttttgttccgccgcatccattgttgggtcagccatcaaagcggcttgcatcttctcttgaacaaaagtttgtgcttctgttttcatcgcttcttgttggttttcaacaagactggctagttttttcgcttgatcaacagttaagagagtccaagaatctggaagagagaacgtattcttttcacgaataaactcttcatcattcccagctattccaaacaagaaacgataaaaatcatttttatacgtccaacgggtcgttttcgtttctttttgtgccgatttggcatcttcgacgacatgattcgtcacatggtccattcttgtttgttttggtttcttttgcgactcatctgtgcggtacaaatagattttctcagttccatcacccaaaggttgatacaacagcattggcaactgatcattgtcactgcttgaaactaacggctgtgtagtcgttgtggtggttttttccatcccaaaatgtgcggatagattggccatcattgctgttaagcttaagacaaaaaccaaaccaaagagaagtgaaataacagtttggactttatttttggcaaaaacatttaataacgcaaaggcaattacactgatgacgacaatcactaacatcatttgccgtcacctcctttaagaacagtcaactgaggctcttttttcttcaatgcaaaggcaatcaaaaagcctaaaaagccaaagacaacagcgacataaaaagcagcatgataaccagaaagtgttgcttcgatcgctttttctttgtaagcaagcggtgttgccttcaacaagccatcacttggaagatttcctttggttacatttgataagacactgatcaaaatcgccgttccaattgagctggcaacttgacggaaagtattattaactgctgtaccatgactgatcaagtttcctggcaaagcattcataccagaagtagtaactggcatcataaccatggaaatcccaaacatacgaatcgcataaagaatgacgatatgcaagatcggtgtgtcttttgttaaaaaggcaaaaggcaatgttgcagcagtcaaaatgaacataccggtaatagctaaacgctttgccccatacttatcaaaaattgccccagtgatcggcatcatcgcccccattaccaatgccccaggtaaaagcatcaaaccagaatgaaaggcagattctccccgaatattttggatatataaaggcaagaccatttctgcgcccaccatggccatattggtcacaccggaaagaatggccgctaatgtgaatgttttcgatgaaaagacgcgtaattccaaaaatggatgctcgatgtgcaattgtcgccaagcaaaaaaggcgataaacaagaccccaactactaagaaactaatgacctccacgcttccccagcccttgtctccgacactggaaaaaccatacaacaatgttccgaaaccgatggttgaaagaatggcagaaaaaatatcaattttcggatgagacagctcgataacactcttcatcaagaagacagctaagatcaatactaaaataacgattggaatgaccattccaaacaaatagcgccaagtatagtggtcaatgatccagccggatagtgttgggcctaaagctggtgccaacccaataacgatccccgacattcccattgcagaaccgcgtttttctggcggaaagatcgataacatgatattttgcaacaacggcatggagataccaacaccggcagcttgaatcaaacgacctaatagtaagatcgaaaaattaggtgctgcaaaacaagcaattgtaccaattaagaaaatcgtcatggcagttaaatacaaatttttcgaattgaatttattaatcagccaagcggtaattggaatcatgatcccattaacaagcaagaatccggtcgtcaaccattgaacatcagaagccgtaatatcgaaggcattcatcaaggttggaaaggcagtcgtcagtaatgtttgattcaatactgtacaaaacgtaccgatcagcaaaacgacaaccaataaagaacgattgtacggtttaccgtatatatctaaaggacgattatttgtcatatttcacactcttttcacaaaatttttcaacagcactatacactttaaaactttctcacttatttgtcaacctacttgacacaaaagtaaaacaagttacaatataaacaaatacctttacaagaatggagaaagcatgtctcaaacctttcgtaaattattagaaaatgacaatttgctggtagggatcagcgagcttagccgaatgtgtgaaatctctccgcgtcaattgcgttactgggaacaaaaaggccttatccaatccgttcctcaagaagaaaatgcgccacgtaaatatcgactgcccacggtgatcaaagttgagttgatcaaacgtttccttgatgaaggctttactttaacaaaagcggtagaaaaagcagaggaaaaaataaaaactgcgcaccatatacgtaaagtttttacaggggcactccagaatttggaagtaatcaatgatcgatttactattatcagcctaggacccatcaaggattcaaaccaattgctgcacattatccatgatgatgaatcgaatcagcttgactacgaattattatcggaaaaccagccattggacattgataaatatcgtaatctctgagaaaacaaacaatagttaaaaaaggactgctgcacgcccttcgtctttcgggaatgcagcaatccttactcttgccattgctcgtcatagtacttgattttgttatctaaacgattcaaagtcccttttagttcctcaaaacgttgccgcaaattttctcattcttcgactagtaaatgtttgcgggcctctttcgttctttggctaaaaaatatcatgtatcagtgccacagctagcgattcgctattgcctccaattagatctccttcctttaccgaaaacagcatccattgaacatatgaaaaacaacggcgatgttgcttttacaatttcagaagaagatctgactcaattaaaagaaatcactatgaatgattatggctctaataatgaaattcctgttttcaaacgagccgctacaaaataattgcaactgaagagcgctttcccagaatcatttctgtctcagtgcagaatctgaattctgggaaagcttttttgatgagaaaaagccctaaacttattttgtttcttgcttgaagtgttccttttgagaatgagcggcggttttcagtaaaacgagaaggatcttcacagccctcgcagtcattgtccatttgactgcttccgagagaaatcatttacaaaagccatttttccatgctatagtccctttgaagaagtcaaaggtagaagccgctttgaatagctgacttaattgaaaaattgacaaaattgacaaaatcaacttagtagcattcgtagcgctagctaccaaatcgagaaaaggagtctgtatccatgaacaaaacagaatttttacaagcaatatctggtggcttgatcgtttcttgtcaagctctgccaggggaacccttttataccgaagaaggtggcgtgatccctctttttgcggtggcagctcaagaagcaggtgcggtcggaattcgtgccaactctgtacgagacatccagcaaatcaaagaaaaagtgtccttgccaatcatcggtatcataaaaagagactacctacctgaagaaccgttcatcactgctacgatgcgcgaagtagatgaattagttgcaaccggtgtcgaagtcattgcgctggattgtactttacgaaaaaggcacgatggtctaaccatcaatgcatttatcaaaaaaatcaaagaaaagtatcctgaccagctgctgatggcagatattgcgacttttgaagaaggccgcaatgcttaccaagctggggtcgattttgttggcacaacattagcgggttataccaaagaccgtgagccaacagatggacccgacctcgaactgatccaacaacttgtcgctgaacagttgcccgtcatcgctgaaggaagaattcattctcctgaacaagccaaacaagttcagcgtctaggggttgcaggtatcgttgtaggcggtgcgattacccgccccaaagaaatcgcggctcgttttatcgcagaattatccaattagtttcataaagaatcgcatacttctagggcttctagcgaacaagcctctgatggctgaataagggtaccatgattttagatgcatctgacacaggtgcatctttttttgcaggtattctattctttgtactatttttcctctgttgaatttgattgctgataaccgggagtttcccttgtgagtcgagtcacattttttgttgtcttttttagaatactttatactgaaagaaagaggagaaagtgagtgaagaaaatgacaaaaatcaatgcaggtgtcgccatggtaaaagtctttgaggcttgggggatcgatcacatttatggcattcccggcggttcatttaattccacaatggatgcactataccaagaacgcgaatccgttcgctatatccaagttcgccatgaagaagcaggtgctctcgccgccgctgctgatgccaaactaactggtaaagtcggggctgtctttggctcagcaggccctggagctacccacctaatcaatggattgtatgatgctcaaatggataatgtgcccgtagtagcattactcggtcaagtggcatcaagttcaatgaattacaatgatttccaagaaatgaatgaaaatccgatgtttgcggatgtcagcatctacaatcgaacggtcatgtcccctgaaagtctaccacacgtggtagatgaagctatcaaggctgcctataaatttcggggcgtcgctgtcgtgacgattcccgttgattttggctttaaagagattgaagcccaagagatcgccacagccaaaaaccataaaactggggtgatcctacctaatgaagcagacttaaaagctgccctcccctattttgaacaagcaaaaaaacccgttctttatattggacaaggggtattcggcggatttccagcgatcaaagaattttccgagttcttttcaatgccagttgcggcttctgttttggcgaaaggaatcgttcctgatatgtataagaattttcttggctttgccggaagagttgccacaaaacctgcgaacgaagcactagccgaagcggatctgattgtcttcgtggggagcgattttccatttggccgtcgtttctttaatccgaaagccaattttgttcaagtcgacattgactcctcgaaatttgggcgtcggcacaacacagatgtctcggtgttaggcgatgggatcactgcgttgaatcaatgggtcaccctaggaaccaaacgaccagcagaccaatggctggcagcaaatcaagaaaacattgttcgctggcatgcttggcgccatcactttgacaccaatcaacaagctcctcttcgtccagaaccgatcttcaaagaaattaaccgcattgccgagccgaatgcgattttcgtcagtgatgtcggaaatgtgacgatcaacagtattcgacatttagacatgacaggagaacagcgttttaccacttctggctggttcgctacgatggggaacggtgttccaggaggaattgccgcccaattgagtttccccgatcgccaagtctttacattgagtggggatggcggtttcgccatgcaaatgcaggatattttgacccaagtcaaataccaattaccaatcatcaatatcgtcttctctaatgattcttttggatttattgaagcagaacaagaggataccgaacaaaagaaatttggagtctttctagaaggcgcagactttgggaaagttggggaagcacttggtgcaaaaggatataccatcactcgttacgaagacctaacacctgcttttgatgcagcaaaaaccagcaacggccctgtagttattgatatcaagatcgaaaatgctcgtccacttcctgtagaggaattgaaattggatccagaaaaattttcggcagctgaaatcgccgcctttaaagaaaaataccaagtccaagaaatgcctactttgagagaactgcttaaaggtaattagcataaagctatgccctaaaaaacaaaaaagaccgaacaatcaatcagacacttccaatgtttttcacggaagttgtcaggcattgtatggtccttcttttttgtgttttagatcacaaatctgattggtttgactccttttgcaaatcaatcaagaaacagtctggaaaaacgttcgcaattcttgctttcttgcagctgaaatctgcgttttaggaattccttgtattgctccctcaatcccatagagcatgtgtagacaagccccgggatcccgctgggtacgaatacgcataaaaatggtttctgctgttgcagacttcattttctccaccgaatcgatgccaatcgcatgcaagtgttcggcaagaacctttcctacattcggtattttttgtaattcttccatgatacgcctcctctcaacgatgtttctgcagttttatatttattgaacaaatcttgtttgattgttaccctatattccttcacaaatctgcattaatttgatgggcagaaaaaggaagcttcatcagaaacaataagacttttttcattttatccctcctcttcattttagcgaattgtcccctaaaatgtaaccctaccgtttacttctttagcaacatcgcgattgtttcactctctttcgtatagctttcgccacaaacgttgctataaagctgatactctttaaatccaaccgcagccagttcggcagccaatgagtgctctgtaaaacaactagtccacacattgtaagttatctgatcctcttgagtgatcaccattgtttgatctagccagacaaagttgggatatttactggtcttattcaatgcaagataggagttctcgctccaaaagccagctccttctgagtactcccatgattgctgcactacagtctgatcatatttcgttgcactaaagacatctagcaagaattttccgccaggcttcaaccagcgataaatgtttgctaccagcagatgtcgatcgtttgcagataatgcaccaaagtcgcagtagatcatcacgatcaaatcaaaagtttctgtcaattccatctcaaggtagtcttgttttaggtaggaaataggcaactgtttttttcgtgcagtctcttttgcatagtcgatcgatcgctttgagaaatctacccctgttacttgatagccagattcagcaaacaattctgaatagagccctggtccacaccctagatcaagaaggcttggataatctgctggtgggactttttgacagatccagctagcagattttttgataaaggaccgatttcgactggccccatctatactcggatccaaatgattttctagcattttctgagaaatatagtcatctgtccagaatggggtatcggtttgttgatagatttttggctgtttaatgaagtctttcattttgtttcgcatttttctgctcctttgattgattatttgtgtaactgaatagttttctttggtcctccttttgcgtgattactataaaagaataaaaaaaagcgatggttacccatcgcttccgtgaaaagagaagttagagtaagataaaatcaatagctaggcaacttaaataaacctacaaaagcggttatttttagcctgttcaattgattttatttactcttttccagtcatacctatagcactgattgtgtactatcagctatgccgaacttcatcacctgttcattcaattatgactatactttaccacattaaagcagttgcagcaaaccctttcacgattttgcgttcaacgttacgagcatatgcgattaagaaaatggccatacgtttaagtgatttttttaagtttttgatcgacgacttgatagacctcattagcaactcgatcaacaaataattgatcatgagaagtaaatataactgttccaagataatccctcattagtttttccagggctacaatcgtaggaagatcaataaaattagttggttcatctaaaatgagaacatttgctggtttaacaaaaagtagcgcaatttgaactcgtgtcgcttctcctccgctcaatttttttacgggctttaaaatttctgtttgataaaaaccaaggttatgcaaaatacttctgacaaatgattcagaataatcggtttgtttcattaaataaacaagaattgattccgattcagtcattttataggacaattgttggtaactagcaaaaactaccttaggagataagacaattcctttaccatcatttaaaatatgattcaataaagtcgtttttccacaaccatttgcacctacaatcgcgatacgctttcctaatccaaattgaaaatcacaatcatcaaacaaaactctctgttcatattgaattgaaacgttgtgtccttttatcggataaggattatgaatttctatgccttttggtgctgcaaaaataatttgtctcggctcagtcaatgaatgatgctcacctaaatgatccaaacggcttttcattgcctttgctgttttatgaagattcttttgaattgtatccttttgtttggatgatgccaatcgatcaggacgactatttttctgctgcatttttttagagactttactaatcttttcagcttgctgaagtttactttcaatcgccgcttccaagcgcttcttttctttcaagtgactttcaaacgcatgtttttgatgcagtaattccattttcttttgctgtttatacgcatcaaagtttccgtgatattcccgtacacacccctgatcaatttcccaaattttcgttgctaattggttcaagaaaaaccgatcatgactgacaaaaagcaatgtaccatagtaatgcctcaactcctcaataagcaatgaaatacttttctgatccagatgggtggtaggttcatccaacaaaagacccatttcatagttcgatagtgttcgaaccaatcgtgtctttgcggcttccccaccgctccagctatccattgaatgttttggtaacgaaaagcggctcatgatttcccagtcaacggatgaaaaatcgtaagaatcctcgatccctccaatttaggcaaaataattaaaggtcgtggttgtctgaatcgtgccactatcgggctggatttctccagtaattaattttaacagtgttgactttccttcaccatttctaccaatgatcccgattcgttctccatgataggcggataacgcctcaattgacaagacttctttagcgccatattgttttttgatctgtttgaattggactgttaatgtttccatgaatgatctccctctctcgtctaggaaaaaggaaaacacaaaaaaggcatagcctggcgctatcccttcataagtaattggaaaagtagacactcatcctttgaaatcgcgatcacctagacttttgaatagtattaaattaacgattcaaaagatcgatccacaatttcattgccgctgtcatgacttttcctccttcagtaaatgatttccttaagtatagcagatccgaaaatacttgtacagaaaggttcgcatgagttcgctggaagtcccttacaccagtgtgtcctataatttcagcggaagatctgtcatcctgcgagctcatgggatcgtctgctaatcaaatcattccttcgtaatcacttgatacattttcgcgatatcctcggctgccatcgtgactttagatttttcgatcaatacattcttccctgtcataatataagaaggcaataagcggatctttccatagtagatttcagtctggcgtattttataagttgcaacggagggaatcgcattctttttttgctgctttttggcgatttgattgaaggcttttttggcgacatcccccattagcataatcacttcaatatttggaaataacgacaactctttttctaatagcggtagattttcagtgatagtttgtgtttcaattgtcgtcgtgtgttttggcgttttgatcgcattggtcaaataaatccctaaatccaataagtcatgggcagaatctacatagatcccagcttgttgaaacaacggcaacgtcgtagaaagataagcgccatctgttgccccataaaaatcatctgttggatctaggggaacgacttcattgatcaatactgctttaatggttttcggatcgacttcaatatcattcaaaaagatacttttttctgctccagccatcaatgcctctttcacattcattttctcactccgttcctattctcttttccttaatcatacaaaaggaaagcggcgaagtcgaggagtactttgtgttgagaaaatcagtcggtacccctctctaaaagagacaaaaaactgcgtaaggaggatttccttacgcagttatactcaatgagtcgtgctcatttattacttattgtaaatctttggtcctttacgcatattcttgcgatcattttttggtgtgtccatttgtttcgatcggccaccaccttgtttctttttgatcagttcaagcattttttctttttggttcactatttccacctcgttttcccagaccctctcttatctgataaaacaaatcactttgataaaagaatttagcatcctgattaaatctacttggattttgaccgtttgtcaatcgttgattgcacaatcccacaaatttcacaatataacattcaattcattattcagaacgttcgtcggttgaaaaacttatgtcacacctcgcgaacgtgtgagtcagaatgcttgtaaattaaaagtgatggtatcatcttttttcaaaagcagattttgggcacctttatcactcatttcattattgactgtatagacccaaaatacattgttcttttgatcttgactcattccatcgatcgaagtgataaagccatctttttcttcaatcgtaaagttttctttcattactttcagtagtgattcattttcttgaaaagcaacttcttttgaggtgacttcctcacctttattcgtgataacaatcgtagctgttaattgtttctgatcaacagaacgttctgtgctttctacactttgtgcattttgggtattttctgaagatgtacgcgtatttccttgacagccactagtgacaaataatccgcctaacaacacgattacgactaacaattttttcatttatttattccttcccgacatacgtcattaaaatctactcttttatccatcgaaaaacatactaaatatttactgaaacacaggtatatctcttatctcttcaatcactaatgatctatttttacaaaccacatttcaattgaattttacaattggtacatgtactacaaccgccaatttcttctattgttccttcatgacagatgggacaaatgtcaccagaaatcactggttcattcgtttgggtggtaaattgatcttctgctggttctacttgagtgtttatttcattgtcgattgcttccaaagtcaatacttgtgagtcacggctgccatccacgtatacagtaccgcctttggcaccaccatcgtagagatccatatagactttcgccacctgacttacagaataccctttcggtgcattgacagtttttgaaatcgaactatccacccagcgttgaatcgcacattgaacaccaacatgttcttctggggacagttccattgctgaaatgaagaagtctggcagctgatctttgtcttgttccggatgattcgcaagatattcttcaacgattgctgcattgatctcaataaatttgcctaatctgccacttctaaaataggagaaggagtagtaaggctctaatcctgttgacacaccggtcatcgttcccgtcgatcctgttggtgcgacagtcaaaagatgtgagttgcgaatcccaaattgcatcaccccttcacgaatatgggctggcatttttttcatataccctgtgtcaataaacttctctcgtaatgcttgtgtctcttgatcatctttcccaatcaaaaatggaaaactgcccttttcttttgctaaatcaatggaggcttcataggcggtgatagcaatcgtctcaaaaatctgatcgactaattgattgccttctgctgaaccataagttttctcacaatagatcagtagatcggctaagcccatgatgccaagtccaacacgtctttcacctttcgcttggcgctcatttttatcaaagaagtaaggggtcgcatcaatgacattgtcttgaaaacgaaccgcggttttaaccgtttctcttaatttagcaaaatcaactgtccccgtttgatgatcggccatgtttgccaaattgactgctgctagattacatacagcataaggtgttaacggctgttcaccacaaggattcgtcgcaaccactttttgcccataggctgtagcattggtcattttattggcattatcgataaagaagatacccggttcagctgagtacgtggcacaaaaagtgatcaaattccacaattcacgagccctgatcctttgataggtttttactttatgaccggcggcttcccattctcgcacatctccgacttctgcccactttgcatcgtattccgccatttcttcttcggaataattatcgatatctgggaaacgcagcgcataccaatcgtctttctttactgcatccatgaattcttctgtcaaacaaacagaaatattcgctccagtcaggaagtcgctttttttaaccgtataacttcctccatgccgtagcttttcttttgctgtcttgatcatttcattttgctcggtatctgatgattctggaagctgagcaatatgggtatacattttttcttccatttttgacaaaggatcaaaatgaagtttttcattgattaactgtttgatagtgtcatttttcaatgttttgtttaactgcagcaatactgcaggattctggattttagaaataatgaacgccaaaatgtctggatgccagtcagccatcatgatcatctgtgcgccgcgacgacttcccccttgctcgaccagattcgtcaaattggctaagtcattcaaccaagagacggcaccagaggatcgcccgctgacaccatggaccacacaagcttttggccgtaaggttgaaccattagtaccaactcctccgccccgactcataatctccatcacttcttgtctgtgtacagcgattcctttacgagagtcgtgaatgaaaggcatcacaaagcaattgaaataggtaacttgagaattagtaccagcgccataaagtactcgacctgccggaatcagattttgttcggcaatctgctgataaaactgctcaagaaacaactcctgctctaactctttatcggaaatccttctagcgactcggcgagcgatttgttcgaaataaagttccagtggtttttcgatctcatttttccgtcgtttgacaagaccattaacttgttcagcagtattttctatagctgagcgatactcttcttcaacctctatggagaccatgtcgtcatcaatagactttacccatccgatgcctcgagcaggatattgaggatcttcttttgtggttaaaataaccaaatcacccttatctaatgtttggtggttttgatccttgaaagaatagcgatcgagcatgatcaagcgagaaattccttcaaatgtgttcgtcatctcagtagtgattgctgagacttctgggaacatatgaatgtcctcgtttagcttgcttatcgtttgtttactgtatttcattttttgtgccaccttcccatactcaacatattgtgtccggaattcattatcacactacataatgtgtttttcaatcttgaaatttattttttttcatgtataatgagaatgattatcaattagaaagacggcgatttcgatgttccagcctcatagccatatattttccgttcaaaaaatttctctattagcactccttactgcgtcttgtattgttggacgcttattttttgtctggatccccaacgttcagcccatgagtgctattttatttttattagccctggcaggcagtttgtctgatgctttgatcgttgctttattgagtttgcttggtacaaatatctatttatggatggggccttggacgatcagccaatttgtagcactggctgctatgattactttttttcatctgggaggaaaaatatctctcataaagcaaagccgcttaatccaagcacttctagcgttcatttgtggtattctatacggtttgatcgtttctatgatggaagtctggctttatcagtttccttcttttacagcctattatcttcaaggcttcgtatttgatttgtttcatgctagcggaaacttcctgttttatttgatcttattccccgtatttgagcgaatgatgcccgcattaaataaatggagaaaatagaaaagcgtaatctttgctcgaaccatcaccaaattaggagcacttaccaactcttttgtcaaagaaacgtgaagcggattcgtcaaaaaaaatctttttaccaagttagcctaggcttcttaacaaggtaaaaagatttttattgtttgaagagaactttctgattcactgttcctgttttatcctatttttctgttgtgggtagtcaaggcgatgcaactgatagagtgcgtcttcttccgttttgactaacgaaaaaaaattttttctaaaagttttatcgaagctagatttccaggcgctacctctgcttttactgattgaacaccttgatcaaacagccactgtatcgtcgcttgaatcacttctgagccatatcctttttgagactcatgaggatggatcgtgtaaccgatccagaaaaaatctgcttcattttttaaatagatatcaccgatcagccgttcatctaaagtgtgcacaactgctaaatttttgccttcagaaaaactttttgtatgcagcagttctttgatatacgcagctttttccctgtttttgaaaccttggtacttcatccactctaaatcatttctataggtcataactgttgggatatcttcgatcctaaaatcacggataaaacaacgtggtgtgcaaaaatacatgatacccctcctcattgcatcttgacccttatctcaagtagagagtcaactgacgttttgcttattgaaaatagactcgctagttccttgatcttgggtgaacaaaaattttttcgtaagaaagaaccttgactttcttttgattcatttgagcaatggtttctttagtgggccgaaaacctaacgatcgccaaaatttacccgctggttgattattcaataaaacggccaaggctagtttcgtcatcccttcagaaagaagaatttcttctaatttatgaacgattgctttcccgtgtccttgcctcttttcattgatcagcaataatccaatataagcggtttgctcttctggatagtcaactaagtagtcaatgatcgccaccggctttgtatcctttctaactaaaaaaagcgtttattttctttctttactgattcaggcttatctaccatatcttgttttaataactgcaaggaagccacatcatccgttaaagaaaagtacggctgattatttaaatagatggaaacagcttcctgttcatttgcgtcagtcactctctcgaaagtaaacattggtcaactcctttaaaactttttcttttgtgattgtctcaagtcattttcttgtctgttctatgcttgatgtgctgcagtctgctgcggttggcagccagcaacgaaatacatttcaatgggatttttccgtaacttctttctctctttttaggattgctgtcaaatctgcgagatatttctcctgttgcttcttcaaatatcttttagcaaatggtttcaaataaaacttcttcagcgttacctcttccgtaaagatcatatctgtctgagcacctgatttggtgaattttccttgccaacgccctcgcatatttgtgttttccatcgtaaatgaatacaacgtgaaaggctctttgtcgataatcgtaaatgttgtgggatacccgctttttgtgtattcgataaactgcctttcattgatcacctcaattttacttaaatcacttcgccaggaatagtcctgaagattggtgacaatttgccatatcttttggatatcctgatcaatactggcacgaatcgttgccttgaccatagagttcctccgttatcgttaatttgtgttggtatctgtccaagaaatgctcattcgttcaacgttcttttaagaagattctcatggaacgcagtcgccgctcctttccattcgtcccttcaataagtgaagggctcagactatttctgtcaggacaaatggcttcacatacgtttctacaaagtcgacccgatcaaggaccgtaggtttgaaatacgcggttacagcaataaccagtttgtttttcgaatcaacgtaaatgacattgccgctattgccaattgctgaatagacattctgctttgggtctagtatccaccataaatacccatagtgcatctgctgaaattggattagagctggctgcgttggtgtactcatttctgcgatccattcagcagagacaatttgttttcctttgtgtcggccttggttcaagcagagttcgccaattttcgccatatcgctggctgacaagcacaaaccataaccagctgtaccaacacccaatggatcacaaaaccaaaccggctcctttggctcttttccgatagtgaactgcttgtgttctgctgctgtttcggcatggtaattgtgatgtcgactaacgccgatgggttcaaataaatagctgtttgcaaaatcaaccgtggtcatttttgttgcttggcataataaaccagtcaaaatatgcagacaaactgttcgataatcaaattgattcgtcaacccttttcttccacccaaaaagtctaaagaagctttcgtccaatcttggctagtacagacttttgtccaaggatctccttttcctttataaggtgcctgcatggtgagtaagtgtttgatggtcacgtcatagatcgttttttctcctcgtttcacgctataatcaggaaaataatcaaggactttatcttcaatactataaatttttccctgatcgatggcgattccgatcaacaacgatactacgctttttgtcgccgacattacatggcaagtatcatttctctgataatgattccattcatctgaatagacttcttcgtggttcttgtaagcaacaatttgacaaatatttggctgggtactcgtaatcaactcatgcaattctgcttttttcatcatcattctcctttcaagaataagcataaatccattaaaaatagattacaaggctccttcttcggagaattaaaattttcagaatagttttgcattcaattgatttcttccatgctttgaaaaaagcgacactcaaagtcaatttatgaccaataaaacccagtaattagagaacactacctaaacctttcacaatgagtttaagagcggaatcagccaataattgacaggactttctttgatcacatgtcaacaatttttcttacagtattggctgttcggatggtcagttgatcctttacctttggctttgcggtctttgcccaccaatttgttttttgatgttctttgcgaataaaggaccaaaagacaatgtctttataaggatacactctttcaaagtccgcttttggttcaccaatctcagtcagtaaaacttcaaaagacaatggcttcatcataaatatgacgttgtcataaatttctttgttctcatctccccaccattcaggagcatttgctaataattcttttagttcggcttgtaaaatcacatgaatgggaatgtctaactcaaagccgagcttgatccttgttctcattttattggctaaaatctgtgggtcctctctgttactggaaaagataacattgccactgtttagataagtgacaacatctgtaaattcgtctttctttaattcttcttttaattcagacatactcaacttatttttcccgccgacattgattccccttaataaagcaacatatcgatccattcttctgactcctttaccaggttcactttcgtttctgcaccaagaacacttttaaagaaaagttcttttcgtctctagtccacttcaacacacctatttacttcttagataaaaagcatagttttcgtaactgccttgcttttcaacattcattctgaaagatctttgaaataaagcccagttccttcatccaattcaaagccattttttccaacacagcgattgaaacttgattttctggcactggatctgcaatgattcgacgagcctgttcatggctcatgatatggatgacgagtgctttgatcaacatatttccaaatccttttttgagatacgtctcttccccaatgaaataatcaatgccaaatgttccagccggctcatgttcccatgggtaccctttaacggtcttttcacacacgtaatattggcagaatccgatgggcttatcatcaagaaggacgataaaatgatggatataatcaaattctcctgtttcatttctgatttccgtcaaccaatcttctgccgaaccaagccatttcttgatatactcttttcttaaccagcgatcgactagttcgatctcattggtcaatggacgaagtgtcaaacaagtttctgtcattttcttgcctcctgttctgctgaattgccaaaaatgctatgctaagttggttaatatttcttgataacgtttcgttgctaattgactggcctgtccctttttacaaaaattcatctttcctaacttcggcacaacacgttctacaatgactttgccctctactaattttgtttcaaattggtgtaacgcttccaaaaagcgctcatctcgtttcgcataagggtaaaaggataaaacatacagataataaaagagattatatcccctaaaaggatattccgtctgcatgaacagcgtgccaatgccataatgacaaggactgattggctttttcagtctccaatgcgtcaacagaaactcgatcgcaggatggataaccgcttgattctttccgaatggactatagcgaaaggcatctaataacgttaaagtcgtcatcggtgtagaatgctccgtttcaggtcctcgaccaaagctatacttgttgcatttccaaccccgatcttcttgctgtgtggaaataaaatagtcgaaggtcttaagaagccgttgatcttccgcataaccgagaacacacaggttccttagggctaacgccgtatggcaaggatacagcccaccagatggggaagttttgaaacgaccatcttctctccaagtgctgaaaatcagctccgctgtttctgttaggatcgcatcctggggagacactcccagttcaagtaagtacattggactttctaacgtggtaaacggagcccctttcaataattttcggtcctcagtcgtccagtaatcggcgccattgtcgtatcgatgtgcgataatctcttctatgtcttccaaataaagtttatccatagccttctcctctgcctaaattagactgcaagcaaatataaactggatttcctgtaaaaaaacttagtagcacgtctctagcaactctccttgtttctctggtcaatcctgttcgaagaaaacccgataagcatccgttttgcaggatttttgttattttttcaaccgaatgtcttgaacggtgagtgaaaaactatcgcattgattttcctcaagtttactatttccctgtttgaaagtaaaatggagaatgaatcaatcatctacttcagaagttaccaattttgattaaattggtttgcctttgaaaacaaaaagacgactcttttgcagagacgtctttaacaatccattcaatccatatgtaagatgaatcatccacctcattaagtgtatgactttatcagtttaactttccttctcaactaactttcttacataagctaccaacggttcaatagcggttctatcactaaaatcgaccgtctgtccatatgtttcgatcaatgctttgttttccgaagtaagttcagcatcaggtactttttttaacgagtttattatcacttttaacagcagtttatttgccatgcttaattgtgtataatcgattccgcctcgaaaatgaaaaataccttcgggaatgctttttaatttttgaagactcttatctaaatcagcataatccgtaccgacgggatcgctcagaccaactgtaaatacaaccagatgatcgaaaaggtttcgtttcagtaaatcaacaccagtgattttcccagcataaataggaccgccaaaaatgacaaatgaatatttacgcaattctacgtctttgacttttttcccgtcgataagtgctgcgttcaactcttctgcaatccatctggcatatttttctgtcatcccatgtttagaaaagtatacaaccgctaggttatccttcatcatgatccatctccttgattatgcgttccagattctctatcatttttagtgtgacttgagaagcaattgccaattcattgtctgttattcctgtaaaaactttatctcgaaaatcttgactttctttttcactttgttttgccaattgttgtcctttttttgttataaaaacttctttgactcgcttatcttgggcactttgactaactgatacaagtccttctttttccattgtgtcgagcatcttggcaatattttgtcttgatgtattcatcgtactcgctaattcattgacactaggtacactcactttagaaagttctctaagattcattagtaaaaaccattgtttcgtggttaatccagtgacagatttgtctcctgcaaattggagtttgttcgctagaataaatgttccaccaaataatagatgtctaggattttctggggccttcatcagcatttccctttcacaataggtaataggttacctatattatatgcaacctattgcttattatcaagattaagttgtcgcgtttagtttattacattaaaatgcgccttcttctcgtaatcgctagcttttgttcatctacttaaaaagaacgactcaggatattttctgagtcgttctgatatttgtttaatcttacttggtcaacaagaccacacattccacatgagtggtttgtgggaatagatcaactggctggacttgttttgtcacatagccttcttctgcaaatagcgctagatcacgtgctagtgtggctgggttgcaagaaatatagacaatgcgctctggcttaaccgcagccgttgtctcgataaagctagcttctagaccttttcttggcggatcgacaaagacaacagttggctgaatgccttcacgtaaccattgaggcataatcttctccgctttgcctacaaagtaatgaacattttctaagccatttctcgcagcatttgctttggcatcttcgaccgcttcagcaacaacttccattccgagaacttcttggacacgatcagctaaactgattccgatggttccgattccggcatatgcatccacgacaatgtcatccggctgtagatctgctaattcaaacgctttttgatacagcacttctgtttgggccgtattgacttggtagaaagatttggcagagatttggaacgtcttatcgaacaattggtcatcaatcgaagcttttccataaaggactttctctacatcacccatgatgacattggttttttcttcattgatattttggatcaccgatactacttcaggaagctcttcatgaatgacttcagcaatctcttctcctttgaaaaacttcgcttttcgtgtgactaaaacgaccatcatttctcctgagtggtgtccgcgacggatcacaacgtgtcgtaaaaagccttcgtgagcttcttcgttgtaggctttgacgttaaaacgctgcaaaatgttccgcacggttacgatcgcttgatcgatcgccggatcttggatatagaaatcttcgattggcaccaaggtatgactatttttgcggtaaaaaccagtagtcaactgccctttgattttttgaacgggaatttgcgctttgttacggtagccaaaaggttgttccatgccgatcgtaggcaatacctcaacttgcggcattttcgcgacttttgctaaaacattctctacttgttgttgtttgaatgccaattgcttttcgtacttcaaatgactcaaaggtgcgataccggttcgcaacaaatcttcattaggcagttcttgacgatctggactcgtttgtaacagtttcatcactttggcaaaaccgaatttgttgccaactttcaacactttgactaacgcacgttcgccgggtaatgtgttttcaataaaaagtaaatagccatcgactttggcgatgccgtttccttcatgggaaagatctaaaatatcgacctcaagttcctgattcttcttaacaggataatttttcataggtttctcctttgtacttgcttttctcattttaaaaaggaatcactgaaattgcaagcgctgtttatttcgatgatggctcttcgccaacattttgaacaaaaaacatccgaaggatagaatcggctgattgcttttaggctctgcggcgaagagccgctgcaccacaagagcaattccttttccatccttcggaaaatcatctacacgagaagtcttagacttccttaggtgttttatttatcagctgtttttctttttctgtgatttttcccgttcgctcttgttcaagatttgttttctcaaacgaatgctttctggggttacttcacagtattcatcatcgttcaagaattccaatgattcttccaaagaaagaatgcgaggtttcttgataacggatgtttggtctttgtttgctgaacgaacgttagtcatttgttttgctttcgtgatattaacggttaagtctttgtcacgagagttttcaccaatgatcattccttcgtatacttcggtacctggttcaacaaaaacagttccccgttcttcaatactcatgatcgagtaagtcgttgctttacctgtatcgatagaaaccagtgcgccttgatgacgaccaccgatttgaccttggatcattggcaaatattgatcgaaggtgtggtgcatgatgccgtaaccgcgagtcatagataagaattctgtcgtataaccgatcaatcctcgagcaggtgccaagaaaatgatgcgcacttgtccatttcctgtattgatcatgtcttgcatttctgctttacgcatgcccaatgattcgatgactgatcccatgtattcttccggtgtatcgatttgaacacgttcaaatggttcacatttcacgccatcaatttcacgttcaatgacttctggacgagaaacttgcaattcaaagccttcacgacgcatattttcgatcaagatcgacaaatgaagttctccacggccagaaacgatccatgagtcaggtccaattggatcaacacgcaatgacacgtctgtttgcaattgagccatcaagcgctcttcgattttacgtgctgtaacgaattttccttcacgaccagcaaaaggagaattgttcacgatgaatgtcatttgcaatgttggttcatcaatatgcagcacaggtaatgaatcttggtgatcaattggtgtcactgtttcaccaacgaagatatcttccattccggaaaccgcgatcaaatcaccggctttggcttcttggatctctaaacgtttcaaaccaaagaaaccgaaaagtttcgttacacggaattttttgacttctccatttaatttcatcaatgcaacttggtcgccgactttgattgatccgcggaagacacggccaattccgatacgtccaacataatcattataatcaagcaatgatacttggaattgcaaaggttcgtcactgttgtcgattggtgctggaatgtgttcaatgatcgtatcgaacaatggcgccatcgttttttgctgatcagctggatcgtctgatgcactagatgtaccgttgattgcagaagcgtaaatgactgggaaatctaattggtcgtcatctgcccctaattcaataaataattccaacacttcatcgacaacgtgttctggacgagcagatggtttatcaattttgtttacaacaacgattggcactaaatgttgttccaacgcttttttcaaaacaaaacgtgtttgcggcatcgttccttcatacgcatcaacaactaagacaacaccgtcgaccattttcatgattcgttccacttctccaccgaagtccgcgtgtcctggggtatccatgatgttgatttttgtgccattgtattcaacggccgtattttttgctaagatcgtgataccacgttctttctcgatcgcatttgaatccatcgcccgttcttgtaattgggtatggctatctaacgtttgggattgtttcaataattcatcaactaatgtagtttttccgtggtcaacgtgggcaataatagcgacgttgcggatatcatttctaatattcaatttataaactccttttttggtgacattgcactcgacaagccattataccagaatttctttctgaaatatagtgcaaagttttcatttttacagaaaaaaacagatacccgtagatatctgctcgtcatttattgatttgcgatcgtcaataattcttgaaatgctgttggtgtgccaccaataaacaattcccgaccatctagagcaagttcctctccggtgatattcgccatcttcaaacctaatgtttccattaagataccgccaggggcatagtcccatggcgctaggttggaaatatagcctgcgcgctgacctaagaccagcgcaatcaattcgatgcccgcacaaccggtcatccgtacacctagtgcccgttcactcatttcgacttcatgatgacgattatgcatcaacatgggcgcatttaatccgatcaatccttcctctaaagcgatatctttcggcggatcgattttttttccgttgcaaaagaccccaatttccggaccaccccaaagaaattcatttttcatgacattataaacaaagccaaaacgtccttggccttcttcatatacagcaatcatgatacagaaattctctttttccaacacgaaattcatggttccgtcaataggatcaatgataaatactcgtccactaaaatctgaaagtcgatctaaaccattttcttcccctagaatttttgcttctgggtcaaaggcttgaatcttctcaattagaaaatcctgcgtcgccttatccagttcagtcaccaaatctttccgacctgattttgtttcaacgatcagagactctttatttaggttttctttgattttttcccctgctgcaatcatccagctatggatttcactaacgatttcttgcatggttgctttctactccttcattttcagtttaccgcttgtcgtcttagccgcttgaaccgttcgatacaatgagtatccgctcaagtcttcgaaatctctgcctaaacggcgctcttccccaatacttggcacaactttcttaaactgctgataagcttctaaaaactccgctgccgggatccctttctcgtaggcttgttctaagcgatcccatagattcattacaataaccatttcatctgttgaccagtccagatctagaggatattgataatcacgcattttaatcacccctattcgtcctattcagtgtaccataaaaatacaaattggtcagagactctgtcgcaaaataaaagagaacagctctcaatgagagatgcaccccctatttaaaaaaaatgaacgaatgttttgaagaagaccccatgatgcctaggctatatcgccttttacagacttaatcgagcttagtcctagctctaactaaaatacgagataccttaactcattccacgttggttcatttagatagttgtgctagaacttcagtaaagtctttaacataatagcgtaggttttttcttcccttaataaggatcgtatgtccctcgttttccaaagcgcttttttgtttctcgattccgcctggatacttaggatttaactccccattcgcttttaatgtccgccagaaaggaattttatctgtttttctttgttcactagcccatgctgcgatggaaacaaaaatacccgcggtgattggatctgtgaaatcggcgccatacctttctgccagatactcgcgaatcttactaatcgtcatcacttggcctaatgggatacgccccatgatttgattgtaatccactggaggagccaaaagcattctctttcccccatatttctcaatactcttttcatctatgatttgcttgattttcggcattcctttcgtctcatggagcatcttattgaaatctttctttttttcatcgaccatactagtccctcctttactttcaaagtaccgccttctaaatcaaactgcaatgagaagcttcaaattattttgaaaaagcatgcaaaaataaaaaattcttgatgatctgaacggatttccaccaattcacgctgatataaaactttgtatattctgtgccccattgccatggaatagggaaagaaccatcttctagctggttctctgagattttagcggcttcttgctgacaaagttctttatcaaaaatggtgagcatttgttctttcgagaaaaaaagtccgatggtttgctggtgtaagaagtgaaccattcttctgggtctttcgagacggtttgacgaatttgttggaacaacacttcttgaaaatttatgttcgccaaaagaggttgatcatgtgtttttttacaatagtttagtatttccaattaaacgactaatgtatgcctatcatcgttgtctcattgagaaagcttcaatggcggtttgaaggattccctccgtttgttgagataaaccagtagcttccacgcggatgatcataccagcaaaactcacggtgggattattagccggcacacctacaggactctcccaccagatggcatgggggtaaaagcagtcggaggtacttggttccgccatttcccttcagaaaaatctttcgcactggacaactacctcaagatcccctgtattataggatttttagcatcaaggcaattgatctctcataaaatactgcaggcagctcacgccgcaatcggggtgctgttgggtttccaattgtctggctctaagccgtgaccaaagccgccatcctcgttttgatagacctctaacatctgtaaaacattctcccgactaccgtcttcaaaatgaatctgccagcgtgcaagttccaatggacgtacattctggtaaatagattgtctagctttttcaaaaggttccctattttcacgctcctattcagtcttgttcagatctgttcagacttgttaaggcttgctaagacttattggttactttgattatgacctaatttattattcgttacaacgcttacactgctagaactatcccttcattgatcttctattttctttaacgactgctttttttacccttgcggctaaactttacagataaatgctagtcgtctttcttgaaaagcattcttttggtgtttccttttccttgatgttacagtaagaatagcaagaataaaggaggatttcatttgcgcttagaaaataaaaaaatcatcgcgttagtcgacaatgatttcgaggatttagagctttggtaccctgttcaccgtttgcgagaagaaggcgctcaagtggatttagttggcgaagaagcccataaaagctataaaggaaaatacggagttcctgcagaatccgcgtttgcttttgacgacatccatgtggctgattatgatgccatcttagtccctggcggttgggcaccggataaactgcgccgattcccacaagtcatttcttttgttcaagcaatggacaaagaagaaaaagtcattggtcaaatatgtcatgccggctgggtcttgatttccgcgaatatattgcaaggaagaaaagtgactagcacccctggcataaaagacgatatgacaaacgccggagctacttgggtggatacaccagttatcaccgacggtcatatcgtttcaagccgtagaccacctgacctgcccgattatatgcgggaattcatcgctgttttagaaaagaaataacccggctaggctgattcactttaacgaaaaagagtggcgaacaatcatcgccactctttttcgttatcatttttgaacattgctctagctatttttgtcattccttgtctgctattcggaaagatcggaaacagcagaggcctttggcagcttacggatcccccatagcgttaataacgctccaatcaaagcaaagcacgtgccgcacaataacatctgccagacaccgaagttctgtaaaaggctgccgcctaagatattccccagcacaccgcctaatgtcgtcgcaataatgatcagcgtttgtccaaatacccgatcttcatctgccaatacgtgattgaagagataagcagacgctgggataaataaagcaaaactaaagccctgcaataggtgtgtcatttccatcataacaatcgtgctgataagcaacatcattactcctctgactgcaaatgcgatactagaaaacaaaagccaaaacttgctggactttcttttgaccaaatgttcgaagaatatcattcctggcaactcgcataatgcagcaatcattaatgaaattcctatttctttgctgccgcctccgatcgaagcaaaaatctgtgccaagaagctattgatcattgtgtgaaagctgaacagaaagctgaatcctataaataacaaaagtaaaaaaggatatttttttcctaacccacccgaatgcttctcttctatcttcaacggcagaacccttgtcttcactgtgggcagcaaaagtaagaggacaaaaaacagtcctgcttctactaatgccattattgggagaagcgcagcagaatagctcgccaacaactgccctaataagaaagaggttgcggcatatcctagtgaaccgcctgctctcgaaaaaccaaaattaatcccatagccagtgttcacatactcaaatgcaagagcattgataaatgactgcatggaaactagcacgattgcaccaatgataaaactgataatcgtcagtgctggcagtaataaccctactagaagagcgataatcaggctcagtgtcatcccttttaggacagcaatcaagggaatcctttttcttttaatgatcacttgactgatgaaaggctgaagcgcggctgaaaaaatattgataagtgctaagatcccaccgatttttgctggatcgatcttaaaataaatcagaaataatgtggcaaatccataaattgaacaaaacatcatccaataaagaaattgcagacttgtataatagagacgaatcgttttcccacccaattgtttacgcatacaatccccgccttcatccgttttagatagcaacttaatatagcataattcagacagatttgctacagcaatcaagtaggcaaccgtcagtattttatgccattcactgatacttgatcacataaaaaaactcgctcatcgaaaggatgaacgagtcttctatcattaaatatggattggtaagcctaatgccaactcagcagcatccatggtgatctcacctaaagatggatgtgggtgaatcgttaacgcgatatcttctgcgttcatacctgattcgattgcaagagccaattctgaaaccatatcacttgcacctaaaccagcgatttgcgcaccgatgatcacattgtcttctactgttgttactaagcgtataaatccttctgttttaccaagagacaatgcacgaccatttccagagaatgggaatttgtaagctttcgcttcaattccagcatcttttgcatctttgatcgtcataccgacagaagctaattctggatcagtaaaggcaaccgctggcattgctttataatcaacagcaacttttttaccagaaatggcttcagcagcaatttttgcttcataacttgctttatgagcaagtgctgcaccaggtacgatatctccgattgcaaagatgtttgatacgttcgtacggccttgtttgtcaactgtgattaatccacgttcgccaacttcgacaccggcttgctctaagcccatgtcatctgtattcggacgtcgaccaactgtaaccatcacatagtcagctgtcactgattcttctttgccatcaacagcgtatttaaccgttacactatcgccattatcaacagcttctttagccattgcattagtaacgatcgttacgccttttttagcgaagtcttcttcaactaatttaaccatatctttttcataagttggcaaaatttgaggagaaccttcaagaatcgttacttctgctccaaggtttgcataagcagcaccaagttcagaaccgatgacaccgccaccgataacaacgaattttttaggcacttctttcaatgccaatccgccagtagaatcaagcacacgtccaccgaatttgaaaccagggatttcaattgggcgagaacctgtcgcaatgattgcattattgaaagaataagtttgagctgaatcaggatgaatcacacgtaatgtgtgatcatcaacaaagaaagcttccccttcaattgtttcaactttgtgttttttcaataggaagccaacacctgaagtcaatgttttcacaactttgttgtctttccattcttgtgttttagcaaaatcaagagatacgttttcgcttgttacaccaaacattgtcgaatctagtgattcttggtaatgatgtcctgctgcaatcaatgcttttgaagggatacaaccaacgtttaaacaaacaccgccaatgtattctctttcaatgatcgcaactttttgtcccatttccgctgcgcggatggcagctacatagccaccaggtcccgcaccgattacaactgtatctaattcaacagcaaaatctccaactaccatttgttaatcatccttccatcattaatagctctggatcagctaatagacgtttgatattattcattgcttgttgcgctgttgcaccatcaacaattcggtggtcaaagctcaatgaaagtttcattacgcggccgacaacgatttcgccctcagcattgacgattggttgttgcgcgattgtaccaacacccaagatagctacttcagggtagttgattactggtgtgaaccagccaccacctacagaaccaatgttactgatagtgatcgttccattgcgcatgtcatctgcagaaagtttgccgtcatgagcaagtttagctttttcgttgatttcatcagcgatagcaaacattcctttgcggtctgcatctttgacatttggtacatataacccatgatccgtatccgtagcaataccgatattgtagtagtttttgtacacaatttcttgttttgcatcatcgattgaagcattcaagatagggaattttttgactgtagcagtcaatgcttttacaacatatggcaagaaagtaagttttgtgccattggcagcagcaacttctttaaatttcttacgattatcccaaagatttgttacttctacttcatcatgcaatgttacatgaggtgctgtatgtttgctgttgaccattgctttcgcaattgctttacgtgttggagttaatgctacacgttcttctaaatcacccaagttagacttgaaggctttagctggtgctgctggtttgctttcagctgctggtgcttgtgcttcttcttttgctggagctgctgcttctgcagttgctgaagctccgccaccagataggaagttctcaatgtcttcttttgtcacgcggccacctttgccagttgcagttacttgtgtgatgtcgacatctttttcacgagcaaattgacggacagaaggcattgctaatacacgtttgtttggatcagcagcttcaacgacacttgctgagtcagaagtttcaactttttctggcgctgcagttggcgctgcagaactagcagctggtgcactgttgtgtcctggagcatcgatttctactaatacatcaccaacattagcaactgttccttctgatacaaggatattttttacagtacctgtgactggagatgggatttcttcaactgatttgtcgttttgaacttccaataaagtatcatcttcattgatggtgtcgccagctttaacgaaccattttacgatttcgccttctgcaattccttcaccgatatctggtaatttgaattggaatacgccttcgccttctgaagaaccagcagatgcagctcccgttgttggaacagcagctggttgtgcaggagtttgggcttgcgctgccacacctgcatctccttcattgtcttcatggccaggtgcatcgatttctactaatacatcaccaacattggcaactgttccttctgatacaaggatattttttacagtacctgtgactggagatgggatttcttcaactgatttgtcattttgaacttccaataaagtgtcatcttcattgatggtatcgccgggtttaacgaaccattttacgatttcgccttctgcgatcccttcaccgatatccggtaatttaaattgaaatgccattttctattcttcccttcttcaactattaaaagttcacgatttctttcactttgtcttcgatatctttagcatttggcaaccagatattttctgcttgaccgaatgggaagattgtatctggagcagatacacgtccaattggtgcttctaatgaaagaaccgcacgttcagaaatttcagaaacgacttgagcgcctacgcctgcttgtttttgagcttcttgaacaacaaccacacgacctgttttttcaacagatttaatgattgtttccacatcaagaggagcaactgtacgcaaatcgataatttcagcattgatgttttcttttgctaagttatccgctgctttgattgcttcacgaaccattgcaccataagtgatgatcgatacgtctgttccttcacgagtcaccgctgctttatccaatggaacttcatacgcttcttctggcacttcttcacggaatgaacggtaaagtttcatatgttctaagaaaacaacaggatcattgctgcgaatagaagcaattaacaatccttttgcatcgtatgggtttgatggaatcacgacacggatacctggtgattgagcaatcaatccttccaagttatctgagtgcaattctggtgtatgcacaccaccaccaaatggtgaacgaatcgtaattggcaagttgcgtgtgccgcccatacggtagcgagtacgtgccatttgtccaacgatttcatcaaatgtttcaaaaacgaatccgaagaattgaatttctggaactggacggaaaccttctagtgctaaaccaaaagctaaaccgccgataccagattcagcaagaggggtatcgaaaacacgatcttcaccgaatttttcttgtaaaccttctgttgcccggaaaaccccgccgtttttaccgacgtcttcaccaaagactaaaatttctttgtcgttttccatttcaacagctaaggcatctgtaattgcttgaatcattgttttttgtgccatgactatttcgactccttcgcttcgtaagttgcaatttgttctttaatgttttgaggttgtacttcaaacatatttttcaagaaatctgaaactttttgtttaggtacacggtcagcttcagcgattgcagctttgatttcttctttagtttgttcaatgatttgttcttctttttcttcagaccatagtcctttttcagtcaagtacgtacggaagcgaaccaatgggtctttttgttgccattcgctgtccatatcttttgaacggtaacgcgttgggtcatcccctgataatgtgtgtggaccataacggtaagtcaatgtttcaatcaaaactggtccattgccatttgctgcccattcacgagctgcttttgagacagtgtaaactgctaatggatccataccatccacttggattcctgggataccagctgcagctgctttttgagctaatgttggcgcagcactttgaacttcacgaggtgttgaaatcgcaaaaccgttgttttggatgtagaatacagcgtttgcatggtaagcaccagcaaagttgattgcttcatagaagtccccttgtgaagaaccgccatcacctgtataagtgaagacaacatttttcttgttgcgctttttcagaccaagagctacaccagcagcttgcacgtattgcgcaccgataatgatttgtggtggtaaagcttgcaagtcttctggataaaggtttccagctacgtgtccgcgagaccataagaacgcttctttcaatggaaggccgtgttggatcaattgagggacatcacggtaacccggtaaaagcacatcttctttttcaaatgcaaaatgacttgctaattgacttgcttcttgaccagctgttggcgcgaagaaacctagacgaccttgacggtttaacgcagtagagcgttggtctaatacacgggaccataccatgcgagtcatcaactcgactaattcgtcgtcacttagatcaggtactaaatctggatttacgatttttccgtctttatctaatgcttgataagttggaaaatctgcattgacttgctccaaaattgcttggaaatcaagtgctttttgtttttttgccatcttgacacactttcctctctgatataaaaattcactttcgaatgtaacagggataaaatctgtatcatcgaaaaatcatttactattataaattatcatttaaacgagaataagacaagtgaaaaggtatttttttttaataaaacgattcccattagaccaactcttaagaaacgattagtgaaaacaatcacatttaagcaatcgctttcttgctttgctccttattaaattctttttttcttttaagaatagtacagacttcgccttttaactaaacagaaacgtaacacctcgaggactttcccttgtgaatgttccgacttagtaaaattagttttttttgataatgagaaaaaaataatacagaatagaataaaaaagaaacagatagcataaaagttaaaatcttttatgactatccgtttcttttctcagatccactcttttgtataatggatatagattctcttagctacttctacgcttaccaggtaggcaagaataatgccgacaaaccatggccagtaagaagatggtagcgctgcaaaatcaaagactgtgtgcagcggcgacaagataataccgaaacccaccaaaatcgcaagaacgcttgacagtaagactgctggcgatgcgatactttggaaaaatggcagtttacgcgtccggaccatatgcacgactaatgtttgcgtcacaagaccgatcatgaaccagccggcttggaacagcgcttgttcttgaatggcatttgcttggaacacatgccacatcacgaagaatgtcaagatatcaaaaatactgctgactggtccaatgcttacggtgaatttcaataagcctctgacttgccacttgactggtttttctagttcttccacatccacattatcccaaggaatagtcaactgtgccatatcatagactagattttgcaccagcaattgaatagaaagcattggcaagaaaggcaagaatgcactagcgacaagaatcgaaaaaacattcccaaagtttgaactcaatgtcatcttgatgtatttcatcatgtttgtgaaaactttacggccttcaatgacgcctttatctaacacattcaagcttttttctaataaaatgatcgaacttgcgtctttggtaatgtccgcggccgtatctacagaaataccgacatcagcagcccgcagtgcaggcgcatcattgattccatcccccataaatccgacagtatgaccatcggcttgcagcgactgaatgatgcgtgacttttgcataggattcaacttagcaaatagattgaccgcttctgctttttcagccaattcttcatcagagagacgatcaacgtctatccctagaagatagtcgttcacttcgatccccacatctttacacaccttttgcgccacgatcgcattgtcaccagtcaaaactttcacgttgacaccatgaccatgtaatgaagcaatagctgtttttgcggactctttcgctgggtctaaaaagcccatgaatccgatcatgatcatatcttgttcatcttcaactgtgtagacggcttctgcgtgagcatctcgcttgattgctactgttaggacacgcatgccctgtttgttcaagcggtgatttacctcacgaagtttttctcttaattcatctgtcaattccagaacttgtccgttgacttccacgtatttgcagactttctccatttcctcagcagcaccttttgtgaccatgatttggtgtccatctgctttgacaaccactgttaaacgccggcgggaaaagtcaaaggggatttcatccactttgatgacttcttgatacggtgcttggcgctctgtatcttcgaagtagttcaataccgcaatatccatcaaatttttccaacctgtttgatagtaggaattcaaataggtcatatccaacacttgttggtcttctttaccaaacggattcagatgctgcactaatacgacgcgatcttcagtgatcgtgccggttttatccgtacataaaacgtccatactgcccaagttttgaatcgaaggcaattctttgacgatcactttttctttagctaacgacatggcaccttttgccaaattacttgtgacgatcattggcaacatttccggagtcaagccaacagctacagcgattgcgaagaaaagggcttctccccagtctccttttgtcaatccattgatcaaaaagacgatgggaaacaaaaccattaccattcgcagcaacaatttactgactttcgtcaaaccatcctcaaaagtagtctttcctcgttttgacgttgcatttttggcaatatcaccaaaaaaagtactttgaccggtttttaaaataattgctttaccttgtccactaaggacatccgttcccatgaaaaccaaatcttgcatatctaatgcggaaatcgtttctttagaatctttgatcccagcatcgacaaatttttccaccggcatagattctccggtcagagaagattgattgataaataaatcttttgtccaaatcaaaatagcatctgccggaatcatatccccggttgccaatgtcacgatgtctcctggtacgacttcatccatcggaatctcgatcgtttcgccgtctcgagtgacagaacatgtattttcaattaattcttttaaagccaaacttgctttttgcgaacgatattcttgcacgaatgtgatcgtaacacttgctaagatcatgattcccatcacgaccactgcttcataatcacctgtgaaaaaagaaatgaccatcagcaaagccaaaactaatacaaaaggatctttgaaagcacttaaaaacatcagccaagcaggtgttggtttttgtgcatctacttggtttggtccatattcttccagacgttctgctgcatcctcttttgatagtccattaaacgaagtccgcatttccatcagcaactctctttccgaaagttgtgcaagtaattttaattcttgatctttagataatttttttaacatcttcttttcctcctataactaggagttgcatttgctacccctagcattctttttattgttcatctggggactggggtattccatgttcatcttcctctctgtttatcaagcaagaaactctggatcatgcagaagtgttggtcaaaaataaaggcagtcagcaattgtcttgcagcacctcataaaggtctgtatgtatcagctaaaataaaggcatcagtgaccattaacacaaaaaaacgcatgctcccaataagcatgcgtaaaaaactcatgatcattgtagagctttagcactatagggcgtagataacttgacgttatcagctgctttgggtttaaccttcacgattagacctgtcctaccaactaagcatctctcgatacttttgcggcagcagcttgtgtccatataggagcctcacctaacaattatttatttctatcctcactatagtctatctaattatataggtcaaccattatgtgaaaatacttttgttatttttcaattccattttcagtttttggatcattggatcgaaggatctgccattccggacagacggtaatattgagccaacacttctttgattcgctgacttgctttaccatcaccataaggattttcagcatgcgccattgcggtatatgcagcgtgatcctgcaacaactgcttcgttgcttgatacacatcctcttcccctgtaccgaccaatttcaacgttcctgccgcaatgccttctggacgttcagttgtgtcccgcaacaccaatacaggaacaccgagagaaggggcttcttcctggacaccgccggaatcagttagaatcaatgtgctttggttggcaaaattgtgaaaatcgatgacatctaaaggttcaatcaatgtaacattctctaaagcacccagagtttcttgggcaatttctcgaactttgggatttttatgcatcggaaaaacgactgagacttctggaaactcgcctgcgattcgagccaatgcctgaaaaacattcttcatcggctgacctaaattctctctgcggtgcatcgtcaacaaaatctttcgctgttttctgtctgttagtgtaggatgctgatagtcttgagaaacagtgtagcgcatggcatcaatcgcggtattgccagtgacaaagatggcttctggatcatgattttccgcaagtagattttctttactttgaagcgttggagcaaagtaaagatccgctagcacatcgatgagttgccggttggcttcttccggatagggtgatcgtttattccacgtccgcaaaccagcttcaacatgaccgatcggaatctgagcgtaaaaagctgcggttgctgcggcatatgccgttgttgtgtcaccatgaacaagcacaattgacggtttttcttggtggagaatcggttctaattccagcaagacttttgtagtgatgccggtcaacgtctgtcccaatgtcatgatatccaagtcgtaatcaggttcgatcgcaaaaacctctaatacttgatctaacatctcgcgatgttgggctgtcaccacgacaattgattgaaatcgaggatcagcctctaattcttttaccaaaggcgccatcttgatggcttccggtcttgtcccaaaaacggacattactttgatagtcaaacactcacctgcttctttctgcatgtttactttattgttattgctcttactcacttagtcaactgaatatccgcttttagctcagaatatttttttagttttttttcatcatttcttctattataacgaaagattaagaaaaaccaaatagtcgatagagatgattccacaaaaagcagaaggtcagcgctgaaaataaaaaaaccaaaagacttgttgccctcagcagcaagtgataagaatgttttgctatcgcttgctgtaagaccaaagaaatcttttggatcgaacttttattcatgccactgtcaattctacagccgaagcaacttaaattgtatcgccattgaaaatcgagtttttcacgatcacataatcaacttttcgaatcgattcgaggtctttgccaccggcataggagatcgatgattgtagatcttgctgcatctcaaccaaagtatctttcaaagaacctttgtaagggatccagatttttttcccctcgacgtttttcttttcccctttttggaattcagaagcagagccaaagtattcttttaaaacgacaccattttcgacttttgtttccccgggagattcttcatgtccagcaaacaatgaaccaatcatgaccatcgttgccccaaaacgaacagattttgcgatatctccatgggtgcggattcccccatcggcgataatcggcttgcgagctgcttttgcacaccagcgtaatgcagctaattgccacccaccagttccaaaaccagttttgattttagtgatacaaactttccctggtccgatcccgactttcgttgcatccgcgccggcattttccaattctcggaccgcttcaggtgtgccaacattccctgcgatcacaaaagcatctggtaaatgttttttgatatgttggatcatattgatgacagcattggaatgtccatgggcaatatcgatcgtaatataatcaggcaccagtccttcagcagccaatgtttcgacaaaagtatactcatagtctttgacaccgacactgatcgaagagatcaggcctttttccttcatttttttgataaaaggaatgcgggctgcttcgtcaaagcgatgcataatataaaaatagccattttcagctaaaaattctgcgattgattcatcaatgatcgtttgcatatttgcaggaacgaccggcattttaaatgaatgtttgcctaaagtaaccgtcgtatcacattctgaacggctattcacgatacatttattagggattaattgtatatcttcgtaatcaaaaactttcatgtcaaacataaaaatatcctccaaatcttgataagagtgaagcaagcatcaaatggctgtcgcctatttttaatgcccacaacaatttaaaccagctcactcataaatacaagtgttttagaatcttttttttaaagagcaacaggaatgttcgtcttttacgaacattcctgagatagtttccattaaataaagggtttcttctttttttaaggtaaaatattgccagctgccaaatatacttcataccattcttggcgtgtcaacacaatcgtagatgccttagcgatctcttcgatacgatgcggcgtcatcgtgcctgcgatcacctgcatatttgctgggtgccgtagaatccaagcagatgcgattcctgtcgcagtcgtttgatacttctcagccaattcttccagttttgcattcagttctgggaatttctcatttccgatgaagacaccttcaaagaatccatattggtatggcgaccacgcttggatcgtcatatcattcagccgagaatactcaagaattccgccatcatgatcgacactgccgctatccgtcatattgacatggatgcctcgatcgatcattccagtatgcatgatgccaaattgcaattgattggccagcaatggttgagagacatattttttcaacaattcgatttgaccaggattttgattgctgactccaaaatacttaacttttcccgctttttccagctcgtcgaaagcagcagcgacttcttcgggctccactaacgtatccgggcgatgcaacagcaacgcgtcaagattatccattttcaagcgtttcaaactgccttcaacggatttaataatgtgttctttcgaaaaatcgaacattttccctgggacgataccacatttcgattgaatgaaaagatcttcccttttatattcggtttgtgcaagggcatctgcaaaaatactttcgcattcgccaccgccatagatatctgcatgatcaaagaaagtaataccattctcgattgctgtcgtcagtacagctacaggatcttttgcattattgattcgcatcaatcccaaaatgacacttgaaatttctaaatcggttgaaccaaatttaatttttttcacgtatttttcctcctctgtttgctcttctattttagcatatccgtttgaaaacgctacctctttttaagaaaaaaagatcgctgttctctcatcagcgatcttttgtttaaacgatggaaccaaagagaagttgcggttactttaatgctttggcaccaatatcttttcgataaaacatcttgttcaaaggcatttttgctagcgcttggtaaactttcttttgcgcttcctccaaagaagcaccttgcccttccgctaaaaatactcgcccgcctgctgccaccaattctcctgctctttcagcaacccctgcataaaacagttgaacatcttcagccgctttttgcggaatgatcattccctgttgataggtttctggatacccttcagccgccacgaccacaccaacagaaaactgctgatcccaagtaatctccggctgtcttccattgagcaatgcatcaataatctgagctaacccactcgttagccgactcaaaacgacttgcgtctctggatctccaaaacgagcattgaattcaatcactttaggtccttcaactgtggcaatcagccccgcatataaaatacccgtaaagggtgttccttgatcaatcattcctgtagcagccgggatcaaaaccgtctcgattgcttgatcgatcattgactgaggaatttgcggaacaggagagtaagctcccattccaccagtattcggtccttcatccccatcaaacgctcgtttatgatcttgcgcaatcaccatgggataaacttgctcttcatgaacaaaagccagcagcgaaaactcttctccttccagaaaatcttcgatcacaactttggcaccactttgaccaaatttttgttcttccaacatttcttctaccgcagccagtgcctgatccactgttgctgcgacaacgaccccttttccagcagctaaaccgtctgctttgattacgattggggcacctttttcttggatatacgctttcgctttttcactatctacaaaagactggtattcagcggttggaatctgatattttgccatcaattctttggcaaattccttcgaaccttcaatcatcgccgctgctttatttgggccaaaaatgttcaatcctgcagcttggaaatcatcaacgatgccattaagcaaaggaacttcagggcctacaaaggtccaatcgatggccatctcttttgcaaacgcgatcaagctttgatggtctgtttctgggatagcaactacctgaatgccatcgctgaccatgcccggattccctttcgcgcagtagactgtttctacgatcggatctgcgagtaattttttggcgattgcatgttctctaccaccactaccaataactaaaagcttcatctgctcctcctgaatttaatgtcttttaatgtctaaaatgccgaacgccagtaaagatcatcgctactccgtattgatctgccatttcgatagacgcttggtctttaatactgcctccaggttgaatgattgccttgattccccgttttgcagcatattccacgctatcatccattgggaagaacgcatcgctagctaaaactgcatccgttaattttccagcttcagcagcttgttcaatggcgatttttacagaacccacgcgattcatttggccagcaccaattccaactgtttgatattggttcgctaaaacgatggcatttgatttgacatgttttaccgctttccaagcaaaagccattgcttccaactcattcttgctaggctgacgtttcgttacgaccgtccaatccttaggagattctgctaatgtatcttgttcttgaactaataaaccacctaatacagagaccatttctgtttcgacaggatttgctacaaaatctaacgtcatcaagcgaatgtttttcttcttcgtcaaaatatccagcgccgctggttcaaaagcaggcgcaatcacgatctcaagaaatatttgatgcaatgcagcagctgttgcttcatcaacggggcgattcaatacgatgattcctccaaaaatcgaaactggatctgcttcgtatgcccgttcaaaagcgtcaaaaatcgtcgtcgctgttccgataccacaaggattcatatgtttaagagcgactgcagtgggttccgtaaattcttttgcgattcgcaaagcggcatccgcatctttgatgttgttgtaggacaattctttgccgtgaagttgttttgcactagcgatcgaataaggaactggcaatgcatcttgataaaaagcagcagtttgatggctattttctccgtagcgcaacgtttgtttcaattcatacgtcagtgtcaacttctccggttcagactcttcaactgcttttgtcaaataatcggcgatcaaggcgtcataagctgctgtatggcgaaatactttagccgctaagcgtttgcgcgtggcaagctgcgtctgaccggtttccgtcaattcatctagaatgaggggataatctttaggatcaacgatcactgtcactgcagcaaagttttttgcagcggagcgcagcatgcttggtccaccgatatcgatattctcaatggcttgctcttctgtcacatccgcttgggcaatcgtttccttaaaaggataaaggttgacaacaaccagatcgatcggcgcaatgtcatgtttttccattgctgctaaatgttcaggcaggtcccggcgacccagcaaaccaccgtggatctttggatgcaatgttttgacacgtccgtccatcatttcgggaaatcctgtaaccgtttctatcgcaatcggttcaagaccagccgcttccaaagcagattttgtccctcctgtcgaaatgatttcgtagccgttttgtactaaatttttggcaaaagatacgatctcttgtttatctgacacactgatcaacgctctttttttcacgattgatggtctcctttatgaatgatttcagctatgaccgctggatagactcgatgctctaaatgatggatctttgcttctaagctttctaatgtatcttccgattcgatacgtaccacttcttgcgcaatgatcggccccgtatcgataccactgtcaacgtaatgaatggtgatcccagtcaccttcactccataatgaaaggcatcggcaataccggattttccagaaaaactaggcagcaatgagggatgcagattgatgattctattgggaaaagcggctagcaacgtaggtccaacgatccgcatatagcctgccaaaacgatcagctcaatcgaatgttccgccaactcgttcaacagtgcggcttcgaacgctgctttcgaaggaaatttctgcggggataactgcaatgtcgctacccccgcgtctttagcacgttccaagacaaatgcggcgggattatctgagaacagcagcgctaatgtagcccctttgagttcttcttctctaatcgcatcggcaattgcggtaaaattactgccgtttcctgatgcaaaaacagcgatcctcatagcggatctccttgtaaaagaaccgcatgttcttgagcctccgttactttaccaataacgtaagctgcttcattctgctcgtttaacaaagctagcacttgttctttcttctctggtgcaacagcaagaaccatcccaatccccatattgaagatctcatacatttcatgggccgggatttttccataagaagctagagcctcaaaaatcggcagttgcggccacgttcccagtgtgatttctgctgttgtctgcggcggcaacatccggggaatattctcgataaagccgccacccgtgatatgcgagataccgtcaattaattgtttttcaagtaacggcagtacagcggatacgtagattctcgttggtgttaacaattcttctccgagagtttttccgcctaattccggcaacttctctgccatttgaaaaccttgctgttcaaaaaagatcttgcgaaccaatgaatacccgtttgaatggataccagaagcaggcagcccgatcagaaaatgtcccggttcaatcgatgctcccgtgatcagacgagatttttcaacaattcccaccgcaaaaccagccaagtcatagtcctcttccgagtacatccctggcatttctgctgtttcaccgcctatcagagccgctcccgactgaacgcagccctctgcaaccccggcgataatttgttcgattttttcgggatcattcttgcccactgcgacataatccaaaaaatagatcggttctgctccttgagcgacaatatcattgacacacatcgcaacacaatcgattccaatcgtttggtgttgattttgttggatcgctactaataatttcgttcctacaccatcagtaccggataccagcactggttctttcagcggatagtttgacaaatcaaaacagccgccaaagccaccgatggcacccattacacctaaccgttctgttcttttgacatgttttttgattcgatcaacgacttcatacccggcgttcacatcaacaccagcctttgcataagcatttgccactttgagttcctcctgtaccatttattcgagcgacgctaaatagctttcttcataatcataaagcggtgtaggataatcaccattgaaataggccatgcacaatccagaatagggggcgtctaaatctaacccgattgcttcgatcaagccagtctcactgagaaaagccaacgaatcggcaccgatcgtttggcgaatttcttcgacactttgccgagcagcgatcagttctttccgcgtctgaatatcgattccgtaaaaacaaggatatcttaatggcggtgaagcaatccgaacgtgaacttctttggcaccggcttcttttaacaattgaacgattcgtcggctagtagtgccgcgaacgatcgagtcatccaccatgatcactttttttccttcaaccacaccgcggacggcagaaagcttcatccgaacgccttgttcccgtaattcttgagtgggctggataaatgttcgtgcaatgtattgatttttgactaatcctaattcgtaaggaatgccagattcttctgcaaacccgctggcggccgataaggatgagttcggtacaccgatcaccatatctgcttcgatcggtgcttcttgggcaagattacgtcccatattttttcgtgcagtatggacattgacgccggcaatattcgaatctggtcgtgcaaaataaatgaattccattgagcaaatcgctggttggacttcttccgtatatgtttcaacacggtagcccgcttgatccacaatgacaacttccccaggacagatatctcgaacaaattcagctccgatcacttctaaagcacaagtctctgaagcaatcacataagcaccattgaccatttttcctaacgagagtggccgaaatccatttggatcaagagcagcgatcatcgcatcttctgtcagcaaaagataggcaaatccacctttcacttgattcagcgcttctttgatgcgatccagcaaattcgcttgaccactgcggcgaatcagatgcatcaaaatttcggtatctgaatttgaatgaaaaatggctccttcagactcaagtgatttccgcaaactcttggcattggttaagttcccgttgtgcgccaacccaatctgctgatcaaaaaacttaaaaagaaaaggttggatattatcgacgctgccattgcctgcagtagcatagcgaacatgtccgattgctgcttcacctgtcaatcgttgaagaagtcgttcatcggaaaaaacttctgccaataagccaagatctcgatgaccgacaagcttgccttgctgatttgcgacgatcccagcgccttcttgtccccgatgctgtaaactgtgcaagccaaaataagtaactcgggcagcatctgggtgaccccagacaccaaaaaccccgcattcttcattcaagctttttacttcaatagacatggaattgcttcctcccatttcttacgtgctaaggctgtttccactacgatcattccatcgctaccttggatttttagttgcggttctgctgtaacttttccgatgagacaagcgctatcacctgccaaagcttcaaaagcggtttgattttctggagcaatggacagcacaaatcgcgtttgtgtttctgaaaaaagccaagattgcggcaaatctagttgaacagatataccgacattcttcttaaacgcagattcagctaatacaacagctaatccgccttctgcacagtcatgggcactttttacaagtccagcctggatcgcagataagacgattgcctgattctgtttttcttctaatagatcaaatgccatcaaacggccattgatcgacccattttgtaatttttggagttcactgccgttaaagtcggccttcgtttctccaatcaaataaatcaaatcctccggtgtctggaaatgttgtgtggtgatatgttcgaccttttcaatcagccctaccataccaatcactggtgttggatagattgcctgcccgttggtttcattatacagcgaaacattacctgaaataacaggagtttctagaatttcacaagctttggcaatcccttctgccgatgtccataactcccaaaagccttctggtttatccggcgagccatagttgagacagtctgtgatcgctagtggtcgtcccccagaagcaacaatattgcgagctgcttctgctacagcaatctgtccacctcgttcaggatcaaggtacaagtagcgagcattacagtccgtggtcatagctaaagctttgttggtccctttgatccgcaggactgcagcgtcacttcctgggccaacaacggtattggttctcacttgagaatcataggtttcaaaaatcgatttttttgaagcaatcgtgggttgctgcaacaattgtaaaaagactgctgttgcatcatcaatgactggttcaaaatcaggctgttgacgaaatgcttggattctagcaggttctgctttttctttatgataagttggcgcatcttctgccaaagcatcaacaggtaaattggcaacttcttttccctgatggtacaagcgatacgcaccatcatcggttacttcaccaatcactaccgcttccaatccgtatttttgaaacaacgcttcaacttctgcttcatgtccttgtttcacacagatcagcatccgctcctgggattctgatagcatcatttcataaggtgtcataccagtttctcgttgcggtacatcatctaaataaagttttaatcctgaaccagcttttgaagccatttcagaactggaagaaacgagaccggctgcccccatgtcctgaataccgatcaaactgtctgaatgttcaaggatcagctcaagacaagcttctaataacaatttttccatgaaggggtctcctacttggacagccgagcgctgctgttcttctccctccacgaactcctcggaagcaaatgttgcaccatggatcccgtctctacctgtttttgctcccacatacatgattatgttaccaacgcctttggcctgtcctttttgaatatctttgtggtcgatcaaaccgacacacatcgcattgaccaatggattcccttcgtaacaggcatcgaaggcaacttcaccaccgactgtagggattccgatacaatttccatagccgctgattcctgccacgacttcttctaaaaggtatttggtccgctcattcgtcaattcgccaaaacgcaacgaatctaggatcgcgatgggccgcgcccccatactgaaaatatcacgaataatcccaccgacgccggttgcggcgccttcataaggctccacggccgaaggatggttatgactttccgctttaaagacaactgcttggccatcaccaatatcgacgattcccgctccttcgcctggcccttgtaaaacttgcgggccttcggttggaaatttgcgcaagaccggcttggaatttttataggaacaatgttcgctccacattactgaaaagagacccgtttctgtataattaggtagtcgacctaatatttcttctgaaatcatttggtattcttcatcagtgagcccccattgttgataaagcttggtttctttgatttcctgtggtgttggctctgctatgattgctttattcatgtactggcaccttcccgaaatttttcaataaagacgcaaagaacttcttgccatcctttgagccaagcaactcttccattgcccgctcaggatggggcatcatccctaaaacattgcctgccttgttgcaaatgccggcaataccatgtaaactcccgttaacgttatccacataacggaagacaatctggttattggcttccagttcctggtaggtttgatcgtcgcaatagtaatttccttctccatgagcgacagggatcgtgatccgttcatcttgctggtattcagaggtaaaaggcgtctggttattgacttgcaactgtaccggcttgcaaataaagtgcagcgattcatttctgcgtaaaacccctggcagcaagccagcttctgtcaagatctggaagccattgcacgtaccaaagaccggttttccttcttctgcaaaacgaatgacttctgccataatattcgagaaacgtgcgatggctccgcagcgaaggtaatccccgtaggagaaacctcctggaagcaatacaccatcaaagccagctaacgaggtctcgtcatgccacacatattcggcttcttcgcccatcacatctttgatggcatacattaaatcgacatcacaattcgaaccaggaaaaacgattactgcaaatttcattgttccttgtcctccatctcaatgatttcataacgataagtctccatattgacatttgccagtaacttgtcacaaacttcttcaatttctgccgctactgattctttgttgctgtctgtaactttgatctcaaaatatttcccaatacgtatttcagagacattttgataccccaaacgatgaaccgctcctttgactgcttctccttgaggatccaagaccgactctttataagtgacataaactttgactaaatacatgaactatactccttttctaagcgatttaatacttcttgataaacaggaatcagatccccgatttcacgacgatagacatctttatccaaatgttctttcgttgtcagatcccataagcgacaagtatccggcgaaatctcatccgctaaaagaattttcccatcactttttccgacttcaattttaaagtcgaccaagtggatcttaattttctcaaagagttggcacaatgcggtgttgatttgtcgagcaagcattttgatttgagcaacttcctcaggggtggcgattcccaaataacgaatgtgatcttcattgatgaaaggatcgtctaagcggtcttctttgtaataaaattcaataatcggaaaaggcagctgctccccttcagcaattcccaggcgcttagaaaagctgccggcagccgtattacggacgacgatttccaacgggatcatttcaacttcacaaactaattgttcgtgtttagacaatattttgataaaatgacttggaataccctgcttttctaattcttgaaaaataagactggtaatctgattattcagtgctccttttcctgaaactgcatctttcttcaatccattcaacgcggtagcctgatcgagatactccacacggagctcttcatctttgctagtcttgaagagtttctttgctttcccttcgtaaatcaattgttcttgcaccaccggacacctcacaaaagttagttttttcacatagatttttagtctcttcttgttgttttctattctaacaacgcaaagaataagggtcaacaaaataatgtacattaacaactaatttttctttaaacgttcgtgtttaacttaaaatcattttttgttctgcagatttccgacttgttcacacactataaagcgtttacatttattttttttcatgttatattgattttgtgaatattggtatctccaaggaggaattgattcatgtggtcactggaaaatcaagcgcaacgatttatcgctcatttatcggacaccgacagaaaacagctacataatgaactacttgccgttcaacaagtgttgaccgcaaatcaaatgacatctttttatttattcagtccattcaaaaaacatgcccggcctcattattccgaacatcgaaaacgggtactccaatataaaaacggattaaacgaagaattgattatccatcaaatccatcagcagactttctttaaacacacctattgtttccgtatttatttcaatatggaagaaatgcaaactgcctttttggatgtcttgctaaacttactcaatgaggaaaagactttcactcctttaaaacctaattttataaatagttaaactcactcttaaaaaacgcctaaattgcgattttaagggtgtttttttgctatactatctcttagaatacaagaaaggaattctactctatgttatttactaataaaagctttcacgtcttccaagcttcgagcttggaagaacgaatgcaggaaattcgtaaagagatccaaccgatttttcagcaaattggtgaaaaagtctgcccttttttcacagaaaagctagacactcctttttatctgcatatcgcacagcaccgacggcgaagtgtctatcctccagaagaaacttgggcagcttttggaccaaacaagcgaggttataagatggatgcccacttccagatcggtattactcgtgagtatgcttttgtctggttaagtgtgattgatcagccgaaaaaccaacagcaaatcgctcgctgctggtcagagaaaccggcactgtttgaaactctacctcaagattttgtcctctctctggatcatacgcaatatggctatcagccgatccgagaatggcccgctgctctagagcggctgactactgtaaaaaaaagcgaattacagattggcaaagtctatctcaaagatcagatttctacgctcactatggagcaactgttagcagattatcgcttgctgctgccgctttatcggaatcgcgaagagttaccgatacttaaccaagaagggaattaagaaaaatggaacgacaaaatcgccgctctcaaaatcaaccaccaaaaaaacggaagactttactgattgttcttcctctgctcttattgcttgtagtaggtggctttttcggctatcgctattatgacaaacagcaacgacaaaatcaggcagagaaagtcgtccactcattcattgagaacctttcaaaaaacaaattcgacaaattaccatccttgattctttctgatagcgcagaaagaaatggttataccaatgatcaagtagcagaaaaatatcaaacaattttcagcggaattgatgctgccaacatcaagggttccaaaatcactttaagcgatgatgtcaaagatgcagattatcagtttacctatcagttatctctcactactagcttgggggaaatcaaagatctgaattattccggaaccatcaaatttgaaaaagatcagccaaaaatcgattgggctccaaacctgattttccctgacatggctggacaagataaagtaagtatttctgttgatgaggctgttcgaggtgaaatagtggatcgcaacaaaacaccactggctgctaatggcaccttgtaccagcttggggtgattcccggacaattaggagatggagaggataaagagtcaagaatcaaagcgatcgctaagcagtttgacctgactgagaaagcgatccagcaagcattggatcaatcttgggtgcaagacgattactttgttcctttgaaaatcgtggaacccacagctgatctcccaaccggtgcaagcattcaagaaaccgcgggcagaacctatccattaggtgaagccgctgcacaattgattggttatgtaggagacattacggctgaagatgttgaaaaagatgatacattagccagcaatggaaaaattggccgctctggtctcgaggcagcttttgacaaagaacttcgaggaaaaaacggtggtaagatagcgatcaccgatgaaaaaggcacagagcgaaaagcattgatcgaaacgaaaaaaactgacggcaaaacgattcaactcacgatcgatgccaaagcacagaaaatcgcttttgattcccttaagaatcaggctggttctaccgtggtcactgaaccaaccacaggggatctgctcgttctagctagttctccaagttttgatcccaataaaatgaccaacggaatttcacaagaggactatgatgcttaccataacaacaaagatctaccatttatcagccgctttgcaactggttatgctcccggttcaacctttaaaacaatcacagcagccatcggtttagacaatggaacgatcaatccagaaaccgtcctttcaatcaacggattgaaatggcaaaaagatagctcttggggagattacttcgtgactcgggtcagcgatgtcgcatccgttaacttgcgtaacgctctcgtctattcggataatatctatatggctcaacaaacattggcgatgggtgaagacaaattccgtgctggtttggagaaatttattttcggtgaagaattggacttgccgattgccatgaaccctgcacaaatcagcaatgacaaatccttcaattctgagattttgctggcagacactggctatggccagggagaattgttgatcaatccaattcaacaagcagcgatgtactctgttttcgccaatcaaggatctctggtttatccacgattagtgatgggtgcagaaacaaagacgaaaaaagagttgatttcaccagagacgatttcactgatcaatgaggatttgaaagctgtcgttaccgatgagaatgggacagcccattccctagcagctctcggtttgcctcttgctgccaaaactggaacagctgagatcaaggagaaacaagatgagaaaggacaggaaaatagcttcttatttgctttccatgcccagaatcaaaagtatttgatggtgtccatgctagaagatcggcaagaaaactcttctgctacagcattagccccagatcttttgtcttatctttccgaaaactataactaaataataaaactaccccaaaaggcacgctgcttattgaagcagcgtgccttttgtttttttcggggtttattccctattcacctaaacctacgcgcgcaaaaatcgtatccacttgctttaaatgatgatgataatcaaatgcatcatccaagtctttttcacttaacgtagacataatggtttggtcagcttctaacaatggtcgaaaatcccgttgttcgtcccaagcttgtgccgtcttcggctgaacaagatcatatgcctgttctcgagtcatgccatgatcgatcaatttcaacataacacgttgactatagatcaagccaaaagtcgcattcatattacgtttcatattttctgggaaaacagtcagatttttgacgatcgttccaaaacgattgagcatataattaatcaaaatcgttgtatccgggataataatccgttctgcagaagagtgagagatatcacgttcatgccaaagagaaacattttcatacgccgtcaccatatgaccgcggatcactcgtgctaatcccgccatattttctgaaccaataggattgcgtttgtgcggcattgcggaagaccctttttgccctttagcaaaaaactcttcaacttctcttgtttctgatttttgcaatccacggatttctgtcgcaaatttttcaatgcttgttgcaatcagtgccatggaagcaaaatattctgcatggagatctcgcggcaacacttgcgtagagatttcttgaggacgaatccccaacttgttacatacatattcttcaacaaatggcggaatgttggcaaatgttcctactgcgccgctgattttcccagcttcaactccagccgccgctcgttcgaaacgttcaatattgcgtttcatttcagaataccacaaggcaagcttcaacccaaatgtcgtcggttcggcatgcaccccatgggtccgtcccatcatgacagtatatttgtgttcttttgctttttcaccaatgatagctgtgaatgtttctagatctttacggattaagtcattcgcttgcttcatcaagtaaccataagccgtatctaccacatcagtagaagtcagcccatagtggacccacttactttcgtcaccaagcgattcagagacagcccgggtgaatgcgaccacatcatgacgcgtctgtgcttcaatctctaagatacggtcgatatcgaaagttgccttctctctaattttttccacatcttctttgggaatctcaccaagctcggcccacgcctcatcagctaagatttcgacttctagccatgcttggtatcgattttgatctgtccaaattttgcccatctcaggtcttgtataacgttctaacatgcgttactctcctttaatcccaaatattcgtttgatagatttcttccaatgaagcagtaatgtcttcggtcaacaacgtaatgtgtcccattttccgaccgctctttgcttcttctttgccataataatggaattgccaatctggcttatgagcaatcaggtcatatgtttcaatgagttcatcacctaagatgttcaccatgaccgcatcactcaacagtttaacctctgcaagcggccaaccgcagatcccacgtacatgggcatcaaactgactcatagaacaagcttcaatcgagtaatgacctgaattatgtgggcgtggtgccaactcattcacatatagtccgccgcttttcgttaagaacagctcgatcgctaaaacaccgcgtaaatcaagggcttgtgcaatcacacgcgcgatccgttctgcttcctccgctacctcagcatcgattcgagcaggtgcaatcgtttgatgcaagatattgttgcggtggatattttcaaccactgggaaagtggtgatttcacgaccattccctgccaccatgatcgagagttctttttcgtaagggatccatgcttctaattcacaagttccttcccgcaaaagattcatcgaaggcgctaaatcagctgtgctgtataaaacatattgccctttgccatcatagcctcctcgagtcgttttcaatacacaaggatagccgatactctcgatggcatcttgaatatcggtaggactgatgattgtcgcataaggtgcaataacaatattattggcttctaagaaagatttttctaacaagcgatcttgggtgattgccaatagatcagttccctggggaatatttgcatagggcaaaatcgaattcaaagcctctacgctgacattctcaaattcataagtaatcacatcagaacgccgcgccatttcttccagtgcaaagacatcgtcataagcagcaacaatatgccagtcagctacttgtgctgtcggacaattggctgttggatccagcacgccgacacggaaacccatttttttggcactcattgccatcatacgccccaattgtccgccgccaacgattccgatcgtcgcattgggcatcaaaggtttaatcaagttgatcactactttccactactttttctttcaacgtcttttttcgttgatccaacttttccgctattcctaaatcatacatggaaagcatctgagctgcaagtagtcccgcgttgattgcaccagcttttccaatcgctgtcgttgccacaggaacgcctcccggcatctgtacgatggaaagtaacgaatccaatccatttaatgttcgtgattgaacaggtacgccaatcacgggtaacgttgtttttgcagcgaccatacctggcagatgagcggcaccgccagcaccagcaatgattactttcagccctttttctcttgcattttcggcaaaggaaaacatcaagtccggtgtccgatgagccgaaacaacctttttgatatagggaatcccaagctcctctaaaatctcacaactgtgtttcatcgtctcccaatctgacgtactgcccataatgactgctacttgttccataagacaactcccttcgattattcacttaaatactagcaagtgacatccataaagtcaaaaaaaaatcgaactatagaaaaaatacgagatatattgttcgtcttttaacaaaagatcatttcttctctctaaaacaaaaaaagcatcctgttgaccagaatgctttcgtaaatcaaacttcgttaaattctcctgattcgaccgcttctttttttggtaagccattgaataaaagattcaagataatcgcagtcatgctgctcataacaattccgttaccagtaaacatttgcaaggtttcaggtaagcggctaaataaagttggcataatgttgaaacctaagccgaatcccagtgaaacagcgataatcagcaaatttttgtcatttgaatagtcgactttcgacaacattctcatcccttggacagccaccatgccgaacatgactaacatcccgccacccaatacagcttcaggaatgatttgcgccaaagcaccaactttcggaaacaaacctaatataatcaaaaagaccgcagagaaataaatcggtttacgggttttgataccagataactgtacgagccctacattttgtgagaagcccgtataagggaatgtgttgaagattccgcccagaatcactgctaacccttcagcccgataaccttttttcaatgattctgatgaaacaggttgtcctgtaatatctcccagtgcaaaatagacccccgtagactccaccatactaacgattgaaataatgatcatcaataaaatcgaccaaatatcaaaggttggtaacccaaagtaaaacggctgcggcaaatgaaagacaggcgcgtgagaaatcgcggataaatcaactaaccctaagacagttgctagcaaagttccgccgatcaaaccgatcaaaacagcaatcgaacgaagaaatcctttggcaaaaatctgaataccaataattaatgcaatcgtgacaaaacctaagagtaaattgtctggtgcgccaaaggaagctgcggcagcatccccaccaccgattttggtaatggcaacggggatcaacgtcaaaccaatcactgtaatgacagttcccgtaaccaatggcggaaacaagactttgatttttgagaagacaccggagatcaaaacaacaaaaataccagaagcaataatggctccataaatggcaccgatccctgacttagttccgatcaaaatcaatggtgaaacagcttggatggcacagcccaagacaaccggcaatccgatcccgaagaaacgggtgacggtcaattgcagcaatgttgctaccccgcacataaaaatatcaatggaaatcaaataagtcatttgggcttcattaaatcctaacccggttccaatcaatagtggtactgcgacagcacccgcatacatcgcgagcaagtgctgcaaccctaagacagcagagcgtccattttgttcgttcattaagcgtcaccctccaagaaagttgctttaccctcggataaggaagcgatccgcgcgagagaaacaacaggaatcgacatttcttcaagcaatgctcgtccagattggaaggatttttcaatgacgattccgataccagcaaccgttgcaccggcttgctggcataattcgatcaatccttttgctgcttggccatttgctaaaaagtcatcgatgatcaatacattgtcttccgcagacaaaaatttccgagaaatcgatacttgactcgtgacttgcttggtaaaggaataaaccgaggctgtcaataattcttcgtccattgtcagacttttggctttacgggcaaaaatcattggcacacctaatgtttgtgccgtaaataaagctggtgcaatccctgaagcttcgatagtcactactttagtaatctgctctgcttgaaatcgtttggcaaatatcgtgccgatttcctgcattaattccggatccacttggtgcgttaaaaaactatcaactttcagaacgccatcacctaaaacatttccgtctttttcgatccgttcgatcaactttttcatcctatacctctttcctttccatttaggcctatcaacaaaaaaacaccttttttgctaaagcaaaaaaggtgcatcaatggcactttttttacttatagtccgatatttacggtatcgggtagagactgtcgaccttattacgacgatatacaagttaaattttatgaatgataggttcgattatgccgaagattgattaaaaaggcaagtttagaaaactcttccaaaataagaatgttctcattttatttctcaacgctcactaatcaggtttttccatttcccgatagtgctgcatttttttgctgaataactctccattggaaggtggtgtataggtgattgcattggcgcctgcttcgatcgtttctaaaatactttcatctgtagggcctccagtagcgatgattggcaattcaggataccgctcgcgaaaataacgaacagtctcagcggtttttttcccagcactgatattgatcactttgacacctaacttcaatttttcatcaattttggtatatttactagttacggtactgatcacaggaatatcaatgaccttacagacctgctccacagttttcagtggtgtcggaccatttagcaccacaccaatggaaccttgcgcttctgcaaacatgctcatataagaagaacgaaatccttgagtcaaacctcctccgacccccgaaaatacgggaatatcagctgcctcgataatcgctttggtaatcgcagggtgcggggtaaagggatagacggcaatcaccgcatctgcattggtattgcggatgattgcaatatctgtagtaaaaatgatcgagcggatctgtttgccaaaaatttgaatcccgcttgcttgtctgataactttaggaactttcacgatatcttttcgcagttccgttgtgatctttggcatgtatttttcttccatgggcacccacttctttccgtctattggtcgtattgatttaaatgataggtttcaattacacgaatgattttctctgcataatccggatctgtggcataaccagcttcttgcaatgctttggcagctgttttgtagtctgttgccgacaaaacatttacatagagcgctggattccagtctacaccattgacaaagagcatcgtgtggtcatccatggactcttcccacgaatcatagactcgaaaatcgccttggatcgttacccactgctcattataaaactcttgggtatctaatgtcacttttttactatgtccaaatgctttgattccaaaaagattattgtattcactagctagtgtacttttgccccaatcagactccaagatggcttgccctaaaataatgctcggtaaaataccgtaacccttttgcaattcctgtgcatgaggtgcaatgcgatcaataaattcttgctgagtcatttcttcactatcctcttgtttcggcaagggatcggctaaactgttcattgaaaaaataaaagcaagcccaatcaggaggatacctaaaaagacaaacggcagtcgagtcttcgttgttttgcgtcgtttactcattttcttcctcctgttcttttacttgctctagaaattcttccagagtcagttgatgtttttcaatatatgtagcagtttctacaccaacatagcgtaaatgccaaggttcataatcgatctgagtaatggcctgctttccttctgggtaacgaatgataaagccgtattcccgggcatgcgcttgcagccacttgccgccatctgtctcaccaaatcggtggtccaatacggtttctggataagaatcataccattgtcgatcaactacgtctacggctaaacccgtatggtgttcactgtaacctggttctgtcatcgttcgtttggttgtttcgattgccttctctttgttttgtccttgactcatcagcatcgtgacattctgatcaaaaacagccttttgcgaggcgatggagcgaaaggcggagatcatcactaaaggatgaccagctttttctgcggcagcttttaatttttcatagtcagaaacgattcgtttgtccacgagatagccattggttaattttgctaatccccccgtatcgatttcagttcctttattcagggggcccactaaaacaagcgcccaatcatctaaagatactttgggaaaatctttactcttctgagagactcttgcttgttctttttcactgctaggcgccactgtctgactacttgcgattgtttcgctgctcgctgaatgttcctgctgcagactagctaccaaactaattaatagaaagccagcagcagctaagatacctaaatattttttcaaaaaaaccctacctttaattatatgtttcttctaaattctctttgacccatgccaacaactcaattttctcattcttgatttgttgttggacaaaagcaggcagacggaagttcaaaatgtcgtcatagccccattcatcatacgtaatactgactcttaaatcaaggtattgagtactttcttcagattgtgttaataattccacttttgccaaatcatttgaaagccacgtgcgtgcaatctgtgtcttcattttcttgaattcagctaccgcacttgttctcttttcaggatagatcaccgtttgacgaacaattttttgaatcagcatccattcataatcagagaacagcaatttgattttctgattttcagcaggtgtcaaactcgctgtcccatttttccaggcctcccattgttctcgatcgattccaagctgcgtttcatagaaacgagcttccgtagaatattgttcaataactgtacttaaaataattgcaatagacacgttatgcatcatacatccctcctgtatctattttactgaaagctggacataaatggaacttttaactttggctttgcaatatttttaagattcactaagttttgttatactaaaaacgaaggagctgatagaaaatgaaaaaatatcgttggggcataattggccttggagacatcgccacacaatttgccgctggatttgcaagcgatgctagcgaattgtacggtgtctgtgcccgccgttattcaaaagtccaagcatttgcggaacgtttctcgattcctcaggcttatgaatctgctgaagcaatgttggctgatccatcgatcgatatcgtctatattgcggtaccaaatgatatccaccatcactacatcatggcagcactggcagcagggaaacacgttctttgcgaaaaagcgatcactacaagtggcgatgaacttgctgaagaactggccttagccaaagaaaaaggattggttttagaagaggcgatgaccatctacaacatgccgctttatcaccgtctaaaagaaatcgtagcctctggcaaactaggaaaattaaaaatgattcaagcaccttttggcagttacaaggatcctgatcctcaaaatcgttttttcaatcctgatttaggcggcggtgcactgcttgacattggtacttatgccgtctcttttgcccgctttttcatgagtgagtcaccaaaggtagaattcagcagcatgaagccttttgaaaccggcgttgacgaacaatccgtgacgattttgcgtaacccagctgatgaaatggccagtgtgatcctaactttccaagctaaaatgccaaaaacaggaatcgttgcttttgaagaaggctatatcacagtcgaagaatatccgcgagctgataaagcaaccattcactatcgtgatggctccaatgagtttattgaaacaggcgatacgacccaagcactaaattacgaaatcgccaatatgattaaaactattgaaggaacttctaaaggatcgatccatctaacaagtgacgtcattgccgtcttagaccagatgcaacaattttggaagcaaacaaaataaaacaattgactgcccagcgatttgattcgctgggcagtcgtattctttccttttcttaatgatcccgttcagcaaattcggctttgatttcaataaaacgtttaaacgactgcaaaaattgaaacaattgcgcgcgattttcaaactcctcgcgatttctaggcagcggtttttgtcgataatcttgatacaactcttcgatccttagcaaaaggtcttcgccgtcgttagcttcatcaaatgtttctgcggtatacagcagcaaggcacgaaatttctctgtataaacttcttctacccaaatggatcgcaagagaccaatcatttctgtcaacaaacgaacttgcgcacgccgcatcgcaaaatacgcttcatagtaactattcttttggctccattggttttcttgatggacctgtgctttttcttgtccttgtcgaatctttgccaataatgattgacattgcccttgcaaggtcaatcgagaaggttgatttaagtgttcagacatatcttttaaaagtcttttaaacgtcttttctgtttcttgctgcaattctttcagttctttttctccatctggcatataaagattaaatactaatgcaaagccaactccgagaatcatgagcaagaattcattgacgatcaagcgccaagcaaaggattcttccagtaaatagtgcgttactaagactgaattgaccacgatgccatctgtcaatgaaaaacggacagccattgggatgaacaaaaacaaaaagagcacaaaccctaaaggattatatcccagaagcgaaaaactgcaaaatgccagaattgtcgccagtgccagtgagatcaagcgtccaatgcccgtataaagcgatgttttctttgtgttgcctacgctcaaaatcgcaatgatccctgcggctggcgcatataataacccaatcgcttgagccactgccatcgataaacccgaagcaatcgctgtcttgactgttctcattccaattttcattctgcacctcctttcaaagtatactaaacaaaaaaggatttcactagaatttatcggttattttggttatgattaaagaaaaggaggaaatcgatcatgcaatttggccgctttcgtctagggatgcgaacgataaaaaccgcaattgctgtcatgttgtgtatcttgctgtttcgatttttgaatcgcggacagcctttgatcgctgccctttccgctgtcttctcactacgtcaagatttaacaacgaccctttcttttgggaaatcacgagttttaggaaattcgatcggtggggctactgccatcatctacttcttcatgaaacagtatttccacaatgattttttgatcgagttattggtactccccgctttagtggccttcattatcgttctttcggatgggatcaataataattccggtattatttctgggattgctacgatgttattgatcactcttagtgttccacaaggagagtcttttatttttgcattagatcgcgtgttagacacttttattggtacgctgattgcgatcttcatcaattttgtcttgaggcctcccgaaaaagaaaaacaagcagaaatcaaagaagacttggttgtattgaaggaaagagaaacggaattgaaaactatgctggaagatgttcaagaagaaatctccaagcagcaagaacaaaaataaacgccctctcactacttagctttttacgtatcaagacagcttgtgaggaaggcgtttttgctgttttcttttgttgggcaagaaaaatttgatctaccttccagctattgatgaaaatcgataaaacaattaaacgtttttacaaaaaagcacagatcaccaattggcgatctgtgtcttttttctgcttaagcttcgtaccggcaaacaccatctaaaaatgtcgcttgcagattcatttgagggtccaacacgataaagtcagctgctcgacctttcttgatcatgccgcatttgtcatcgattttacaactgattgctggcactagacttgccatcatgattgcttcttgcggggtagcaatctcccactcaacaacatttttgatggcttcttttaatttcaaaatacttccggccaaatttccttcttttagacgagctgttccatcttttacgacaacagggaattctccaagaatataatctccatccggcatacctcctgccatcatacagtcggtgatcaaagcaacatggtcatgcccggctttttccatcaagatctcagctgcttgcggatgaacatgatgtccatcacagatcaattcagagaatacttcttttaatgatagcaatgctcctaccatccctggttctcggtgatttagtcctctcattccgttataggcatgaacaaaaacactggctcctgcttcaacagcagcttcagcttcctgtaaagtcccattactatgacctaaggcaaccacaacaccttcttctgtcacttgagacacaaaatcggtaacgcctttacgttcaggagctaaggcaatttttttgataatcccaccagaagcttcctgccattcgtggaatgtatcgatgtctggatcaccaaaatagattggattttgagcgcctttgtgttcttcagtaaagaaaggtccttcaaaataaatcccttggattttcgcaccggtaacagaatctttcacttgtccgatagtttctgctacatctcttagacgttctttgctggaagtcaatgtcgtcggcaagaaagaagttacaccacaagacaataagccttctgacatagctttgatcccttctgcatcgttgtccatgacatcgtggttcatgaacccatggatatgggtatctacgagtcctggagctatccattgcccagaataatcagttacttccgcatcttccggtacttcattgacgatatcgccaaatttgccgtcaatgatctccagataacctgccccatgaacagctgacttcaaaaagaatttgtccgcataaatatatgttttcatcttgatcgctccttatttcttttcttccttaaaattactcttatttgagtaagaagtcaagaaaggtctacaccatttctcgatgaatttcgaatatcgacgaccgcttgataaagagcaaaactttcatcggctgcttgctgattgtcaagagcgacaaagacatggcctttcagttcaaataattcttctaaaaaatagaaactgttcttttctctggcaagatcgataccttcttctagaatttgtaaagcagtggtgaattcttcttgtttcgctaaaaaaactgcatagttgtagaatactttggtcaaggttgtggtcatccgttctgccggcagcacttgcaccccatggtaacttttttctagatgaaaacgtgcttcttctaattgctgcatatcattatacactcgccccatacaacttaagagtcgaatctccatcacagagatattgattttatcttgctgataagagtaggataagccttttttaaggctttcaatcgctgcttcataatcttggaacaagaaatattcgcaactccctaaaaagtaatagtacatttgcatgtctgcgtccaaatatagatagtccatgatcgttttatcctgcagtttggtcaataactcttggtactctttatgaacaaaatggctttccatttgagcgaacacttgattcgttcgattgatctcttcagcatggagcatcattacttgatctaaggtaacgcctaatcgttgacagatttgatgcatgaccaatacattcggtaattcttcattattttcgatccggctcaaaacactttgtgaacagatatcttctgccaacatcttttgtgtcatcttgcgctttttgcggaacgtgcgaatgatttggccaaaggattcttgtgaatttgccatgactctcctccaactttttcaacattaaaaaaatgcgaattcgcatttttaattttcttcattttagcacataatagcaaaaaggaaagcaattccaacaatatcttggtattttttaacaatttaaaacgaggtgtttctatgacgattaacagcaccattaccttcacttgggaaggcaaggtctatgcaggaaaagtcgaaagagaatatgaaaattcggttcttgtccaagtgacagaccctagcgaagaaatgctggaaaaattcaatgatcgaatgatcatcagtaaaaaaaaatgtcagcagactgctgactaagcatatgcaataagcgctatgattttaagatattcgatcaatcaaaaaaacgagcagttggatctggtccgatgccttgctacaaggtacaggataaggagccaactgttcgttttttttactattgttcattcctactattgcttacttatttttgctgataagtggctaaaaactcccgcatcttttcggtcgttgctttcaaatcatccatattcggtaaataaacgattcggaaatgatctggttcttgccaattaaatccgcccccgtgcactaatagcacatggtgctcatgcagaaaatccaacacaaactgttcatcattcttaatattgaagcgtttgacatcgatcttagggaaaatataaaatgccgctttaggtttaacagctgataaaccaggaatgtcattcaatgcttgataaatatactctctttgctcatagatccttcctcctggaagcagcagttcatccgaactttgatagccacctaacgccgtctgaatgatctgctgagaaagaacatttgaacaaagcctcatagaggaaagcatattcaagccctcaatataatctttaacgtttctcttatccccgctaaggaccatccagccaacccggaatccggctacacgatgtgatttagacaatccaccaagagtcacaacaaagcgatccggagctaatgtagcgattgggacgtgaacataatcatccatcactaaccgatcataaatttcgtcagaaaaaataatcaagtcatggtcgcgggccacatcaacaatttgctgcaatacttcttttggatagacagcacctgtaggattattagggttgatgatcacgatggctttcgttttacttgtgatttttgaacgaatatcttcaatatctgggttccagtcagattgttcatcgcaaatgtagtgtacaggttttccaccagctaaagagatcgatgccgtccataaaggataatcaggcatcggcaccaacacttcatcgccattattacatagcccttgcatacacatggtgatcagttctgatacaccatttccggtataaatatcattgatcgtcacatttggaaacttttgtaattgataatattgctcgatggctttgcgggctgaaaaaattcctttagaatcagagtagccttcagactcccgcacattcataatcaagtcacggacgatctcatttggcgcttcaaaaccaaatggtgccggattacctgtattcaatttcaagatgctgatgccttcttcttgcatccgttctgcttcttctaggactggtccccggacatcataacttacgccttctagttttgatgacttttcaaattttctcattcgaattctcctttgacagtagaatcaatgcaaattaccttggttctagtgatattcttttttaaaagattgcatttattatagcaaaaagtttagaaaaaaaacggtcaaattgacagaactttacgacttttaaataaattcttttctaaaagaaacgaatgaacgctcttttattgcctagacgttcattcgtttttgttcagtcattctctggaaagaattttaaatagcgttcagctaatgcgagatggccaattgaaaattctgtaaaaccagcttcaataaagcgttgcggcagctgaggatcactgatttcgattaaatagacctgttcttgaagatcgattgtcaatgttgttaattcgggaaatgaaaccaaaaactctggatcttttgcttttaaataaattggttcatctactaaagaattctttcccaggtattcatggataatcttgccatctttcaaaaacaaaacgcgatctgcataactatccaaattggtcaaaatatgggaagcaatcaggatcgatttctttttctcccgcaacccttttaaaacgttagaaatcaattccacattggtcggatccaacccattcatgacttcgtccatcaacatatagggcgtgtctgtcacgatctgcatcgcaaaacacagtctttgacgcatccccaacgaataggttccaaccggccgcttgatatagtcagtcattcttaattgattcacggtttgatcaatcagcgcttcctctgatcgccacattcgttgataaagttttaaatgttctaatccgctgagatcattatatagatcgttctgatcagggaaaaaagagattttctggtgagctgccatttctgacttcttggacgtgtaaagctgtgtttgatcgagaaagatctccccactagtcggctgaacaaaattcatcaatacattgagtagtgttgattttccagtaccgttcggcgccaccaagccgacgatttctccaggatgaaaggccaacgttaaatcatccaaaacatttcgtttaaatgtcacagttacgtttttcattgctaacatttccaaacctcctaaacaagcttaaattgcttctgctgtacacgaacaaaaagaccgatctcgatcagcagccacactacaccaaaaagcagcagtcctttcgcaaggacaaactcagaggacccaaaataaaaacggctgaatcctgaaaggatctgaccataattttgatacaaataggcatcatttgatttatccaagaatgcactaaaccagcgtctctgaaaaataagtggactaatcaagccaaaaccagcaagaaagagattggctaattctgaacgccaaagtgtgctcagcaaaagaatgcctcggatatagatcaattgcagcacgattcctacccctatacactgaagtaagaaaactccaacagggcgtgtataaaaaacatcggcagaagaaataggataacgggcatcaaaggatgaagacaagatactgacgggtaggtccaatgagccaaagccgaattggcagccgacaccgatccaaatcaaaacgagtgtactgatcatcatcagtgttgacacaataaacagtgccgctgtcttcgcccaaagaatctcatctaccgtcaccggcaaagataagaataagcttttgtgtcgacgatctttggtcagactatcgattgccaaaaagatcgtcacgccaagaaagagaaacggcaagtaattcgtaaatgcccgctgaacagattggatacccgttttttgttccaacacatacttggaaagctttttgtttggtaattggctggcactttccatccattttgcagtggaggcatagccgtatttcccatcataagccgcataatagttctgataagtataatagtcaggcgtgaagaaaattgtttcatcatcggtatattggagactcagctgataccattggctcgttgctttggcatacttttgccaatcattggcagctagggaagttaatcgtaagctatctgcttgattccatggctcgaacatcgctactgccatggcggcggaccaatgatctgagggattttctgcttgttcatccaaaaaggattgtctagtcaaataccgctgttcaatttcatttttgtctattcgctcaattggccgataggtgcgatcacgaaaactgtatacgccagcaacgattactaacaagcaccatagcccgatcgtttttttacttttgattaattgctgtagttcaaagagaaaataatttttcattatatgactcctttcgctagccagtttttcttatctgcgatcagcaagaaggtgaccgctcccaccccccataagaaaagaaggatgaaagctgtccctaacccgactgtcgattgcgatctgactgcaaactcacctgtgaggatcttttgcaaattaaaaacagcaaaaggggaatatttactgaatggtgtactagctattgtaccgagaccatagcaaagacaaaggagaaaaaaagaaacatagcgatttggaatcaaaacattggccacaaggcccagtaattctgtcacaataatcaaagttgtcaaaagcacgagtaccaatagaaagtattgccagaaaggtacggcatgccaagtatgatgataatagatagccgttggatagtgccaatccccccatcgtccgatcaccgacatggccgcagtgattcctagaagcaacaggctgatcgttgccagatgaccaatcatctttaccccgactttactgatcatccttatagggaagacttgtggataggaatggatcagagaaaaatggcgcttttcttccagcaaattatcgctagcaaaaaatgccaggaataaaaagccaaatcccaataacacttgaatagtcaacgcaacagcagtctgcgcattgtcaacagtaagaaaaggagctttttcctgttcttctaattgcgctgctaccactttattttgctgcaattgccagatagatggtaaaaaggctttatctggtaaagcggtttcccataattgcagctgaatttttgcaatctcttcactggtccgattgaaacgaggaaattcttccatgattagattcgaggcttgccgattagataatgtgttgtttgccagcagcagttgataggtttcttgcttgtcctgagattcatttggataattctgataattgtctacaagccgtaatgcttgcgctttttgcatagtgatttctgcctgtacattcactggttccatgaatgtaagataaaaagcgagccccacaccaatcaagaacgctgctatcatcgtaaacaaaaaacggcgctgccgaatcgatttagccagcagatttttaaagtagttcatttatcaatctccttaaagctccaaagttattttctcattataccagattctgccacttaaatattttttttcaataaaaagcaagaaaaatgtccttttataaatccctaaaatagcattgacaaacgtgaagataatcggtaacatgttttttagacgtgatggctgcaatcagctgtcagtatacaaaaacaataagcagacgtggtggaacggcagacacgcacgcttgaggggcgtgtgagcttagctcgtgtgggttcaaatcccatcgtctgcatcgtaccggcaaattacttcggtaatttgctttttttgtatttccagttcaattagttttatgcaattgttatttataaatctatgacaaagacacaactaggacgaaattgccgtcctagttatgtggttttgtcattttcggttatactgtttctaagtatttcttctatttgtctatacgttgagtcaaacacatagaggattgcatggaaattctatcttgatcaaaggagcgagaacatgtctgatgaacgatggctgcaattgaggagacgccgaaaaatcgaattgtatctttgcttgatcgtggttatgccgatggtctacggattatggttcaatctaatttttcttatcagatatacgactttacttttttgcattgcagtactcacggctctctatgagttgctcaaacttctctatgataaaagaaaccaaaaaaaagaaactagagtcagcaaataattgcttttcatttagaccgtcgttagtcaggtctcactaattaacagcactcgattgaccagtaaaaaagaatgaacttgtctataaaaagacacagacaaccgagctgttttggtttaaacattgtttggtaaatacgtgcaggacactttcttgatcctttagtatttttacaccattctcatcgatcacccccttaacatatacgtacgaataaaatcataaaaaaggagaaataagatgaaaaaaatctgtttcgttttgactgcaagtaatgggctcagttataccacattgtcaccagcgttcttttttgcagattattctgagcttaagaattatttcgccaatgattatgatgtctcaatcaattatttccgcgataaagaccaagtggattatttggttgtacctgatccatttgtcccgtttgacaacgaaaatgatctgccgatcatcaatgtcccagccaactattttgttacaaaagactataaacaaataaaaaacacactagctgcgttttttattaacaatccctaactatcccagtacaatagctacggctttgagccaatcaatcgattacaggagttcatattgaaaaatcaaataaagctacattattacccaaaagtttgggcatctttactctatttactactgatttttttggcactatttgcctatttatcaaaatatctagatataaccttttttacagcgattttccccgacttttatttacacatttccaatttctctattagcttgatcattggtctgctagggtatttttggttattgatgggcgtcaaattcacctatactctcggattgactattttcttgctgattgccaatttattaagcgaaacggtattaggcgttatgaatacccccgatcccctagacatgttttttggatttgttggtaccctgattgctgctgttctactgtgggtgatctctaaatttagtctcaaacttgcagccgaagaatctcagtaactttctgcttatgaatctttggaaaaataatttggtaacgagacgcttacttgctctttatcaagcaaatgggtttattttgacaactaatggcagaatcagcctgtaaaaagcagcttctgctcactgacagacgctcgatccatgcgcatgacgaaatctctttgctcctcaattctttatgagaaagtttttcagatctgttttcagatttcgatcactaaagttaacgacctacactagcagctaagctgcttttttgttactctctctatctttcatgcgattgaataggcattttaaaacttatacctatgatatagtaataaaaaagagactaggggttgatcatattggatccttttgaatctgttgctgcaagactgaccgacttgaacatttcctttgaagtgatcgaacacccgcctgcaagtacaactgcggaagcagacagctttattgctggaattgatggggttcgaacaaaatcgatgtttttaaccaataaaaaaaagaccgcctattatctcctaataatggacgatcaaaaacggcttgatctaaatctgctcaaagaaatcactagtgaatcacgagtcaaattagcttctcctgatcttttgaggaaaaaaatgcacttgccacctggcgttgtctccatatttgggctcttaagcaattcggagcgagatattcagattttctttgagcgcgaaatcactaaagaaccacgaatgagtttccatcctaatacaaataccaagacgatcttccttgctaccaaggatgtattcaactttttaacggtcaatggcttttcttatcagatcatagatatctcctgattttcatggggttgtgctggaatcaatccgcacagccctgatactttttactggcatctattttgtcaaacccgccagtcacccctcatcaatgtgcacaaaacttgctgcccggcaaactatcatctaaaaggtattttttgcttcacatccgctactgactttcaaaaacaaaaaaggacccactgacgggtccccgcttatttttttgtcattgatactttcattaattgatgtttccagacggattggacgccatataatccaatcgcaagaataccaatcaatgccaagtaagcaaatttcgccattggatcgatgccataattagtcataaatgggtcttgaacaaatagtaccaacaaactagttaaaatcaatgaaacccatagcgtattcatcagatgccaccatttcatgttcctgcactccttttttgatatgccaagtatctcataaagccgatctttccccatccgtctttagactgaaactgctatcaaggattcaaaaacatcaaaagctatcatttttacctagtattccattttgacttggatgccatttggatccaataaagccaaacgcctacttgattcaagagtaagggatacattttccttctcaagatgcgtgagcaatgactcaaaggcttctttgtctgggagcacaaaggtataataagccaatcctagatcattgtctgccataggagtcacacctttgcccatccaagtattcgagccaatatggtgatgataatctcctgccgcaaaaaattttgcttggttcccaaaattattttttaagctcagtcctacgacttgggtataaaaagtttctgtctgggctaaatcagcaacttttaaatgaacatgtcccacaatagtacctgtggggaaacttgattgttggctgtctgctgctgcgacaaccccctctgcatccatttcttttgtaattccaacaatttcgccatcttctcgaatatcccattcagattttggtttatcacgatacacttcaatcccattcccctcgggatctgttaagtacaatgcttcgctgtagccatgatcactggcgccatcgatcggtgcattgctttgcaaataatggatcaatgtattgcctaaatctttgcgagtcggcaaaaggaaagcgacatgaaacagtcctgttttccttgtgagaggcaatggattttcgactttgatcaattcaagcagtattttctctgccatacctaagcgagcagtctgctgatttttttcgatcaatgatagtccgatcacttgagtataaaaagcaatcattttttctaagttggctacttttaagacaactttcccaatttgagtctgttcatgaagttgaaattctggaataatcaccgtcattgtttctgctccttttctcatctcgaatggatgacttgttactttaataataacactaacttaaagtaagtaaagagatttgcttgactagcagaattcttcattttttgccaaaacacgcatccttctcccaaagcgatcggtggctgtctcaatttgttgatagcccaatttttcatacaaacctgacagctgagtgacaatatagatcgtatcaaaaccgatctgatgcaagcgccgttctgcagcagataccaattgctgactaagatgattgccgcgatagctgggagcaacatacacggtcgcaataaaaggggcgacttgaagagggacaatatcctctttgacgatcgtacaaaatccagctaattgattgtgggcaacagccacaaaaacgccttcccagtcgttatagcttctctgacgcatcttatttgctacaaatgcagcagctttccaatcgacgctggcaatttgacccgcataagccaaccagtttggttgatctttttgcaaaaatttaatttccatttcaaaaatccttccttattgaaattaagcagcattcgcattattttaccactttcggcttgataattgttttttcggaaacccttttggcgtagttggcttctctaatataataagttcttataaagcacagacgatataaaacggctggcaagccccctctaggctgccagccgtttttatatctgatttactttctgatccatcaatacgcattattgtagattcagaactgttgattgttattgagtatggtggtccagagtggtttgtcctatgaacgaaaattttaaaacaccgtactttcaccatgttttctctcaccaaattcccaaatatcgattgctccacctgcatagccctcagcgatcaatgtttctagaaaactttctggctgcaaatagtgactgctactgcgtaattcttctttgccaatagaaaaactgcctccatgagagtggttgaaaagaacaaacggcactagctttttctcataaggataggcaaaaataagccgacactggttcttgttaattgagttctaacaaaaacttttcgagacaatcgttttctcataaaagaactttcttacaagaactattggttcctttctatgaaatgatccaaacctttgcaacgtttgccgctgtttcacgaaaaatcaccatgaagcacgagaggcttaccattttcttgggaacggtcaacttcaatcccctggctattctcgatatggaaggcatgttcaacatcgactaattctaaacggtcaaaatgaatatttttagcacagccaatatagaatccttgactggtcatctcttccattccagtcatcatagctggttttccgggtatgggctcttttgccatggaaattgctacttcatgaaacgagatatctgaaatgaattgttcagataaaccataaataaaaccagcagcagcatgaacatttcgcgcggagatattgacaaaatgaattctcctaaactgaggagtctcctcagagattgggtaaggatttttatcccaaacatacttttcttttcctttgggaccacaaaaataatacaaattcagcgtaaatgggcaaatcacattgtccataattaggttgttcactcgaatatcctcaataaccccgccgcgtcctctacgagatttcaaacgaatgccgcgatcggtgtcttggaatatacaatttgagatggtcacattgcgaatatctccgctcatttcgcttcctaaaacgaccccaccatgaccatggagcatttgacagttgctgatcgtgatattttcacaggaaacgcgttcttttgtctcttctgttcctgatttaatggcaatacaatcatcccctacatcgatcaaacaattgctgatacgaacatttttgcaagactccggatcaatgccatcagtatttggcgagtctgcaggatttttgatcttaatattatccacagtgatgtcttggcataagattggattgactgtccagctaggagaattaaccaaactaacatctcgcaatgtgatttgctgacaggaatcaaaactgatcagttttggtcgcggatattctaactgctctggatgattgcgaaagacatcccaccatttctgaccttgaccatctatcgtgccaaaacctgtgattgcaatattttcggcaccgtcggcatagatacaagaagcatagacttcccgtttcaccccttcccaacgcgaaaccaccactggatactctttgggatcatccgagaatcgaagaacagctcccggttgtagatggagttcaacattactttttaacatcagtgaacctgttggatacacccccgaggcaaacatcagcctccctcctcctgcctgatgaagctgatcgatatacccttggattgttgctgtcactgacttttcatttaaataatcgttgatgtcaatactaatttccattcttttccccttccttctttaaaggttctattaaaaggctggtttgcacagctgtgcaaatcctttaaagcgatctgaattttttgatcgagatttcctttgacttgctgaacgaaattttgctgattttggaccaatgttttctgaatatccttatacgtgcgatgataaatgaaacttccaaacgctattattaaaacgcttctaattatagaaactggaaggaaaatgttataaaaaaaggttgaatgtttctgattagccctacccttttcatgagatttctcctgtaattactgacagaatcatttcttaagatatgtccattctagcataaaaaatttcttgtgaatacaggttcaaagaaaaaagttaacgtgtgcattattgatatattgacattcctctctttaggatatatgctaaaaccaatgagaaagtcgagggatacatatggtcactatcaaagatattgcaaaaatcgcaggcgtctcccataccacggtttcaagagcgttaaatgacagtccactaatcaagccagccacaaaaaagaaaattggtgacattgcgcgttctttaaattatacgccgaatgtcaatgccaaaagtctagtcaatcagaagtcgtatattattggcctttacttttctaatttgtcggcaggtacatcggatcgctttttggttgaagtgatcaagggaatcaataccaccctaccgccagagtatcgcttagcggtccacgatatgacgacccttaccagtccagttgaggacttgccaaggatggatggcatcatcgttatgagtcaaagtgatcaagatgacactttcatcgaagaaatcagtcacttagatttgccagtggtcgttctcaatcgacaaatggatagaccatcatttttaaatgtcacaagcaatgatgcgcaaggcgtttatcaagccattgactacgcgattcagttaggctataagaaagttgcgatcattgaaggcaagccaacttttcgttccagtatagagcgtaagacaggtttcatgcgggctcttactgagcacgggctagcgtttccaacagaatacgctgtcactggagactattctatcgagagcggtcgaaaatgtgccaaacaattactggaacttgcagagccgccagaagtgattttctgttccaacgatgacatggccattggcgcaatcaacacttgtcttgaatatggccttgcaatccctgccgatatcgccattattggatttgacaatgtcccgttttcaaaatatacgaatcccccgttgacaaccattagcaagcccgtttttgaaatgagtcagcttggggcacaactgcttctagattcaatcaacggctctgtttcacaaaaacaataccttttagatacagaactaacaatcagagattccctctagcattcgcttcttgaatgcttttggctgttgccaaaaatgttaacgtgtgcaaaatggcagacgttcattataaatcaatgaatattggaggttacaatgaaaaaaataactgaaatgactcatcctactcgcaagtcggaaaaagtgattcaattcggcgaaggaaactttatgcgaggcttttttaactggcagctacagcagatgaataagcaaggtctcttcaatggtagcgctgtagtagtccaaccaattcaacaaggtctaggatctctattggcgcagcagaatcatttgtatacggtaattttagaaggattagcagacggccgtcctgtccaaacctctgagatcatcacgacgattagccgcgtattgaatccctatgaacaatggcaggattatttagctctagctgaaattgatgacttggacatcattgtttccaatacaactgaagcaggaattgcctttgatcctcaagacaaacggacagatatgccgccaaaaagttttccggctaagttaactgcgctgctctatcaacggtaccaagcgaataaatcaggttacacgatcattccctgtgagttgatcgatcgaaatggagaaaaattaaaagcgtgtatccaacaatattgctcactgtggcaactagaggacagctttcatacttggttagaaaatgaaaacactttctgctgtagtttagtcgaccgaatcgttcctggctacccccaatcaaaagcagaggagttgaatcaattacacgggtatgaggaccgtttgatggtcactgccgaaccattcatgttgtgggtgatcgaaaacccatcgcatactgtatctcagaaacttccattgccagctgcgagtttgaatgtaatctttactgaagacctgaccccctatcgtgaacggaaggtgcatcttttgaatggccctcatacagccatggtccctctggcccttctagctggtttggcaacggttgaagaggtgatgcttgatcctgattttacatgcttcattgatgagctattcaatgaagaactgattcctatgctagacctgccgcaagaagaattgatccagtatgcggaacagatcaaagaacggtttaaaaatccttatgttcatcatcaactgcagtcgatcgccttgaatagcgtctcaaaatttaaagcacgtctcttgccgttgttgctccgtcatcatcagcaacagttactgccgccaagaatcattgcatcattagccggactgatttacttgtatttaacgaccgattgtcaagacgatgaagctgtgctagctctctttgaaaaggcacgggccctcgactcttctgaacaagtcagttttattctaggacaagaaaagttatggggagtggacttgagcgtgttcaacaaagaagtttcacaaatggtagtgctactttcaaacaagggttctcgacacctcgttgactcattaaaaaatgagccgactcaaaaaaaggcggaatgattatgacagaaataaaaaacaaaagcgattttctcaaattgcatctaaaagacaatgttgcggttgctttgcatgcaatcacgaaagagacacagcttacatttgaagggcgatcctatagttttacagaggagattcctcaaggtcacaagatcgcacttattgatttgaataaaggcgatcacgtcatcaagtatggttaccctattggtcatcttttgtccgatgtaaaagctggacagtggctacatacccacaatgtcaagaccaatctttcaggaacgctggcttatacctatgagccgaacctacaaccagtagtgtatccaaaaagccaattgacttttaaaggctaccggagaaaaaatggcaaagtcgggattcgtaatgatttgtatgtcatacccacagtgggctgtatcaatggaatcgctgagatcatcgtcgaaaatttcaaacaaagtcatcccaacttaggaacctttgactcggtcacgattctcaaacatccttatgggtgttcgcaattagggcaagatcaccaaaacacccggaaaattttgattgatgctgtgcaacacccaaatgctggtggggtgctcgttttcggactcggatgtgagaacaatacggtcgctgaatttaaagaaaagctaggtgattatgacacagatcgtgtcaaattcttagtcgctcaaaaaagccaagatgaaatcgaagcgggtgaagcattattgcacgaattgctgcaagctaccaaagacgaccggcgggaagatgtgcctttaagtgaattaaaagttggcttaaaatgcggcggctcagatggattttctggtatcactgccaacccgttattaggagcattttcagatttcttggtttctcaaggtggcagcactgtgttgacggaagtaccggaaatgtttggtgccgagcaagtattgatgtctcgtgccaaagaccaagcaacttttgaaaagattcttcatctgatcaatgactttaaagattattttctttcgtatggcgaacctgtttatgagaatccttctccaggcaataaagcgggtggaatcaccacattggaagataagtctttaggctgcacgcaaaaatccggcacctctgcggtcgtcgacgtcttgaaatacggagataaaatccgcgaaagcggtctcagtcttcttgaaggacctggtaatgacctagtggctgcttctgctctcgcttcggctgattgtcagttggtcttatttacgacaggacgaggaaccccctttggtgcctttgtccctacgatgaaagttgccaccaaccaagaattattcgagaagaaaccccattggatggatttcaatgcaggtcggttattatatgaaccaatggaagacgttctcgctgattttattcaagcgatcattgcggtcgctagtgggaccaaaacccgtaatgaagcaaacaatgttcgagaaatcgccatcttcaagaatggtgtcactttataaacgaagaaaagaggaagccaatgtttttaaatgatgattttttactaacgaatgactttgccaaagatttgtatcatcaatacgccaagaaaatgccgatcattgactaccactgccatttagatccccaagagatttatgatgatcatcctttccgaaatatcaccgaagcttggttggccggtgaccactacaaatggcggttgatgcgggcatgtggagtagatgaatcgttgattactggcgaagcagcggattatgacaaatttattgcttggtgccagacagttcctaaaattatcggcaaccccctttacgtctggacccacttggagttaaaacgtttctttggtgtcgatcttatgattaatgaagaaaacgcgccagaaatctggcaaatcgtcaaccaaaaattgcaatcaaagacctttagcagaagagaaatcatcgccaacagcaatgtgcaactcatttgtactaccgatgatccgacagattcactagcatttcatcgcaaattggctaatgaagaaagccgctttcgggtattaccaacctttcgtcctgataaagccttaaatatccaacaaagtgggtttaaccactatatcgatcaattagcaacagttgttggccacaggatcgatagctatgaagacttgttaacagcacttgactgccgaattactttttttcaccaaatgaattgtcgtttatccgatcacgcattggatcacttgcatttcctagaaaacagcgtgtctcctcaagctatctttgaaaaagcgagaaatcaggaagtcattacagaagcagaagcagcagtctatcgctctgccctcttgcttcatttatttgaacaatatcacaaccatggctggacaatgcaactgcatcttcatgcttatagaaactgcaacacgaatatgctcaatcaattgggacctgacacaggttatgacggcatcaacgatcagccgatcactagcccacttcaagcattactggatgctgcggagaggaaagaggctcttccgcaaacgattttgtattcattgaatccaaatgattatgatgtgctggtagcgctgatgggctgttatcaaaaagaaggcaacaacaaacttcaactcggttctggctggtggtacaacgatacccgtgccggcatgcgtcagcaattgacgaagtttgcagatggtagcgtgttagcaaattttgttggtatgctgactgattcccgtagttttctttcgtataccagacatgaatatttccgaagagttttttgtgaatggttgggagaactcattcttcgcggcgaagcaccaagtgataccagacagttaaaagaatttgttgaaggtatctgttaccaaaatgcagcggattattttgatttttagaggtggatgatggttaaactaattattgccggtgattcaactgctgcaactaaaatgactgacaagggtccggaaactggctggaaagaaaaataccaaccttcctctccccagaggttacggtcattaatttagctatgaatggacgttcaaccaaaagcttcattcaagaaaaacgcctcttagcagccgacgagcagcttatacccggagactatttcttgattcggtttggccacaacgaccagaaaacagatcctgaacgaggaacgacgccaaaagaacatcaagaaaatttagcacagtttattgctgttgcacaaaaaagcaagcaaatccagttttactgacttctatcactcgcttgaagttccatcagcataatgacttgaatcccctagccgcgtgaccttatccagaagctatgagagattttactgctgcctttgagattccttgtctggatatattcacgatgacgcaaaactatttttccacatttgcaactaggcaagctcgccagttttttttgcatctttcaaaaaacgaatatccgaattatcccgaaggtatcagtgacaatactcacttgaatgatcaaggggctttaatcgttgctcgcttgatttgtcaagcaatcaaagaagcgaatctttctctcagcagtgagatattgctgtaattcggttagaattctttgtttaccaatcaacaacaagcaacgtgtttccaaagggagaaaaacacgttgcttgtttatttcagctatgtggatgtcgcagccttagtgaattaagggcttgtttcttactttgttttattatgaaaaaaggttgaactttacggatagaaaatttttttactgaggcgcatcttcaaacatccaaaccagcgagccgtgatactccccgacatgatccgttggtcgcaataacagcttcaatcgattctcagctaatgtggcggatccactgccttcccagaccggctgtgctttgtccgacaagagaatatcccctgttttatcaacaaaaatcagcgcatctcgcagctcttgttgctgactgtttttaagcggcgtatcgatttttactttcactgtccatttgcttttttctaagcgactgttatcttccactttgattggttgactttcagcaaaaagatactgattaaaagctggaatagggtgtgttccaaaagataagactgccggcacttgcagccttggtcctgactcaggaacaaacacgcgagtttctgctgctgattgatccccctctttattctctagatataattttacctctttattaagccattcttctggtacttcgaaaacgaccgagtcttccgtttgtgtatttcccacatcatagtttcttagcacctgttttttctctccatattgggcaacaacttggacgctttgatggctgtcatgggaaaggtcataagataacttgacttctttagaaaagcgtggaatcacgattctttgttgtcggtcttttaatgtaaagagtagtgggacaccttttttgtaacgatggaaaacttcttgagaacctggcatgacaatgatgtggtctttttcttctcggatcggatagtacccagtaatggtgggatagaacgaagataaatcaacagaatgggtgatcagccctctgatttcccccgaatctaagagcggttgatttttttcatcaacaaatttgatcttcacttcgttatagtagtaaatggacgcagaaagttttccgattaactgttcaccatcaccaatatcttcataaagaattggttgaagttgaaaacagtcattctcgatcagtgcaggatcgaccggttgttctgcacttccagtgaaggtgtggtgaatgataaactgataactattgtcataaaaggcccggttttttagtgtagaagcttttgcatgaacaagcaaattcccctcatcatcgatggtctggtcaaaccaatttgttcgatccgttccagaaaaatctttgatctcgactccttttaattgaaactgattttgatctggattttcgattctgtaagataaagttgttcgagaattgtttgtttcagtgtaaggaactgtttgttggaaacgagtgatcacttcattgttttcgatgttctgagtggctagtgatagattttgttgtgattgccagtttacaagcatcatctgaccaattatctgcgtttccttgtccttttaacgtcaaagtgccttgctcgtcttcgctgtattggatcgtggaatcgggagcagcaaagatatgttctatggcagtagcagcctgaggaattcgtatgtctttccatttgttcaaacccatttcattaaaagtcgtctttagttgaattggctgcatcttatcgtctaaaaattcataggtgatttctgatgtaccatttgcccatattttcaatcttagaaattcgtttttcgtgataagcatatccgcacctgaaggttccaacatcttgacagtcaccttgacattgaccggttgcccttgataatacccaacatttcttatcagagcagcgctctcttttacagaattaatcccagtaactattctttcactatgaagcgacccccaaaagttagaccaaaaaatctaacttttgggggtcgttatttgtatggcaaaatatccttttgaattaaaactaaaaatcgttaaagaatatcttagtggcgtgggcggatatcggtatcttgccaacaaatacggtatttcaagcaagtctcaagtaagtaattgggtgaatgtctatcgtgaatacggagaggaaggtctattgagaaagcatcaaaatcagaaatattctagatcggaagagcacacgtctgaactaccacagtagaaccacaatttctacaggtatggggagcaggtgtgaaaacagcatcgacgatcaacgtctttttcttctgaaaggtctcgtaagagacctctgtaatcatcaaatctttctctattaatcgcagcatttttttgatagaatcattcatatagcatatcgtcctctcagttgtttattttgtcgtgatttaatcatactagagaacgatatgttttttaatacctaaaataaaaatggggctgaagaatcaattctgattcatcagtcccataaattatagagcctttcttttgctaatgagctccagctgtcgcagccgtttttgctgtttatttttgagtaatccaatgcttttgtgatagcatagggataaggaggcggaagtatgaaactaacagttttaggatgtttaggcgcatatccctataagggtgagggaactactggctatttattagagtctgagggatatcatttgttgctggatgctggcagcacgacactgattcaattggaaaaaatcttggatccgttagcattggatgctgtgattttgagtcattaccatcacgatcatatcgcagatctgggtgtcttacagtattattggcagctatttcctaagcaagcagagcggaacgtattgcccatttatgggcatggagaagacagtattcatttcaatgagttgaccatggcgggagttacagaagggcatgattatttacaaacaaaacagttggaattgggaccgttttctgttacatttatgaagacgattcatcctgtaacttgttatgccatgcgctttgtggagaatagtacaggtaaaatatttgtattcacaggcgattccggctacttagaaagttttgtcgattttgccaaagatgccgacttatttttagcagatacctacctctttgcagggaatgagcgccacaaagctcattttacttctcaagagtctggagaaattgctgccgcagcgaaggtcaaaaaactggttttgactcatctcccacagcatggtgatctggagcaactgaaagaagaggcagcagcggcggccaacgggataccggttgaattggcagcagttcaaaaaatctttgagatttaaacccgaggaggagtagcagatgctttttgtaccaaatgaaaacaacgacccaagaatcaacctagccattgagatctttttgctgcaggaaatgaaggtggatgaaccgatcctgctgttttatatcaatgagccgtcgattattattggacgaaatcaaaatacgatcgaagaaatcaataaagactatgtcgatgctcatggaatccatgtggttcgccgttttagtggcggtggggctgtctatcatgattttggaaacttgaattttagctttatcatgccggatgacggtaattcattccgtgatttcgaaaaattgacgaaaccaattgttcaggcgcttcatgaaatgggcgtcgaaggggcacaattaaaaggccgcaacgacctagtcattgatgatatgaagttctctgggaatgcaatgtacgccaccaatggtcgaatgtttgctcatgggaccatcatgtttgacagtgacattaatgaagtggtcaatgcgttgaaagtgcgcaaagataaaatcgaatcaaaagggatcaaatcgattcgttctcgcgtgacgaatatcaaacctttcttaccaaaagacaaacaagatatgacgaccgaagcgtttcgtgaagagattcttttgaagatttttggtgtggattcagtcgaccaagtcaagacctatacattgactgaggaagattgggtcaaaatcaacgaaatttccgacaagtattatcgaaactgggattggaattacgggaaatctcctgcgtttgatattgaacgccgcaaacgatttccaattggatcgatcgaagttcgctttaacgttcaagaaggcaagattacagaagcaaagatttatggagatttctttggattaggagatattgctgacgttgaacaagcttttatcggcacccgctatgataaatctgcattgaaagatgtgattgatcaaattgatgtcaaaaaatattttggcaatattacccctgaggatttgttggaattagtttattgattttccagcaaatcaaaaaaagatgtggatataacgaaaatctatagaataactgaaatgcactaagaaaaagcagccacagatcctacgatctgtggctgctttttcttttagtgaacatgccgtttttttacgggttgcgcttttttctttttgctctttgcttagtaagctcgggcaatccaaacggtgtgtttagcaggtttcccgctgacgatgtcaactgttttttccataggagcttcaaatgggatatttctggtagtaaagccagtttcttctttgatcttggcttcagtttcttctgtcccgtcccaaccaattaagacaaaaccagtgactttatcttcttttttgcaggtttcgatatgtgcttttaactcttccagtgtttcgatatcgtaatactcgttctctttatttctgttacgagctgcttcaagcaaacgtggtgtcatcgcagccaattgctgatccacgaaatcagcaaggtcatcaaatgctacggtttgtttttcggcaagatcacggactttgaccattacatgcccattttctaaatctcttggaccacattcgattcgtaagcaagcgccctttaattcccactcgttaaatttgtaacctggcgaattgtcagaatcatctaagcgaacacgaatacctttggctttgaaagatgcaaacaactcttccaatttttctaaaatggcaggatttttcttccaaggtccgactggcatcaagacgatttgcgtaggggcgatcgttggtgggaaaaccaatccgttttcatcaccgtgagtcatgatcaatgcgcctaacaaacgtgtagaaacaccccaagaagttgtatgtgcataggtatgtttgttttctttcgataaataagtaatatcgaaagcttccgcaaatttcgtccccatataatggctcgtaccggcttggacagcttttccatctttcatcatggcttcgatggagtaggtatccaccgcgccagcaaaacgttcagaaggtgttttttgtcctttgtacactggaatggctaaaaattcttcgcaaagacgtgcatattcatccaaaattcctaacgtccgctttcttgcacctgcttcatcttcatgggcggtatgtccttcttgccataagaattcagaagtgcggagaaaaggcagtgttttcttttcccaacgaaaaacattggcccattgattgatttcatatggtagatcacggtaagaattgatccaatcagaaaaggctgaaccgatcatagtttcagaagtaggacgcaatgctaatggttcttctaatttttcattaccgacttctgtcacccaaggcaattcaggagcaaatccttcaatgtgatccgcttctttcgtgaaaaaactttgggggatcagcattgggaaatacgcattgcgaatgccttctgcttttaaaaagcgattaaattcttcttgaatatgttcccatagctcaaagccatcaggacggaagatgattgatcctttaactggcgaataagccatcaattcggctttttgaatggtctgaatgtaccattctgtaaaatcatttttttgtgtcattgtttttcctccttaaaaaataaaaaagcattccgtcctataaaaaggacgaaatgcttggatttcgcggtaccacctttgttgactattgctagtccaactcatgaaggataaggtcttcacaccgaccgttttgcggtcactaccattggcaggttcttcttattagcgggtattggatttccagcttgctccaactctctttaaccatcataagaatactgatccaaatcttacattcatgctaaatcgaaactcggaaaaaagcaagctttttttgtcattttgttattcattactgactagctctaggtaatctggcaacccatctgaagaaaatgtcagagaaaaacgagtggcttgttcctcatgtaagaccgagcaagacccaaaattttgctgggtcagtttttcaataatctgaagatcaaaatagttttcttcttcaaaggtttcaatattcggcatggcttctttttccgaagtagccaaagttggaaactgacagctgacgaacaattgattctgctgtttgatagcacttagatgaatcttccgcagggcgcgatctttgagtagatacgtttcccgaattgcatagtccattaaatgagcaaataattgtagaaaatcttcttcagctagttctttgattgcgggaatatccacatcataagagaattcaatgcttttttgctgagtcaattgctgataacttgtcaatagcagggttgttagagaatgatcttcacttttgattggacaggattcttctagcgtctgctcgattaggttgatttgatcaaaagctcccagcaaactgttgtcttccagcatgacttttgcagtattcaactgtttgcgaaaaccgagaaaagcttgttgccattgattgatttgttgttgaattatcggttgttgttcttcatacaagcgaatcttgagtcctgcgatatcctgtttttttgttttcccctcattatagaaaaacaaacgcagcaaatcatagcaccagcagacaataatcaagagtacgaagaaaatcgtattccaattgatttttgattgatcgctgtttaggacatcttgaatgtagataaagcagtgaccaatcgcgaataaaacgatccagggagaacaaagaacaaaaaattgattctttttaaccgcttcatagatggcagcaaaggatgtcacaagagtgctaaaaatattcagtaaatggatataatccataatttccggcaagtggagttgatgggaaaagacagataaaatggctgctgcaccacaaatgccatggaagatcacctaaatcttgtacttctgttgaagaacttccattttcgataaataaaagccgatcaagaacattggggtaatgatcgataagacattcaacatcactgaatttatggtggggttaaagagcaaccctccaagaatatcgccaaaaccggcttctagtccagctgacagtgcaaaagcactgaataataatttcgaaacgagtaattttcgtttcttaactaatttaatccctacataaatcaaattaagcaagctgataaaacctgtcagaagaagcatgaaaatattgggaatcgaatgacgaaagacataactgactaaagcgtttgaagaaccaagaaagacctcagcgggatatcctgaataatttttgaaaggactagatacatagatacgtagtgtttggccttggtaattttctggcaaggtgacaaaagagagggttttcccaggattcacaagaccatctgctacttcttttttattggtatataaaagtttatcatttaaataaaccgtcattttctgatgatcgcccaccaacagcaatgtcgggtagtagtgctcattggtgattttacgttccattaccaaattttcattggtaggaatattaggcaaaaaattcacatagttactgtcgaaagttgtttctggttctgctgcagaataatacagccaatcttcctgtttttcaatagaaggaagactgatcactggattaatcagagcagaaatatagaacaagataattcccagagaaaaagcagaaatcgttaagaagggaattgcattcttcaagtttagtttgttattttttttaacatatatgaattctcctgttttttatccacgtctagaataaaacaaaacaattgattaagtcaaatgataatgggtgttatgccagaaataataaaataactaataaaaaaaatcatttaaaaaagcggactcatattatttgaaaaaatcattaatcgttataatataaacgtaatatacaaaaatatcaaaaataaaggagaactgtgatgaaaaaaatttctaaaacaagtatccttctttcttttacaacattaattattatgctttttcctttactcatgattgttattccaaaaatgttagggttacccatcgctattgtgaagagtgacgcaatggaaccaacatattcctctggaagtttattatttgttaaaagtgtggatgcagaaaatttgattgtcggcgaggcaatcacttattttgtgaatcaaggggaacaaatatacacgcggcgaattgctgcaattgatcaaaatgagcaagtgatgtatacgatcggagacattcaagaccacatggaaacgaccaaaatcagaaaaagtcaattacttggccaacctttgttccatttgcctcgaatcggtcatctagtcacgagcgaaactgtttctattgtaaaaaagctttatttggttttcaccatttatattacagcaaccacttttttggtgatgatttctcagatcaaacaagggaaacgaatggtaatgtaagttccactaatcaataacaaataccgcaaacaagttcagcaagtgctgtcctgtttgcggtatctttttgtttagaatcagatttgttgtttattctatcccttttttttagcttcatactggaagcaaagtaaggatcaatccagcgccaagaagtccaagtccaaacaaccaatccttaagggtgactgaataattcactgcataggttcgaggtgcatcaccgacaaatccgcgagattccatggctgcagctagaagttctgaccagcggatcgatttgaccatcagtggaatcagtggttttaaggatagtttggaataagtgattcctcgagatttcagactaaactggatgttgcggtactctttaggaatcataggtgccatatgaaaggctgccattaagccataagcaaaaacaggaggcaagcgaagttgctgttgtaaagaatagatcagctctgttagtgaggtcgtagcggcaaagacacttcctaatgtcccaaaacaataaacgcgactggcgagacgaatgccataggcatatgccgctgtcgtgctgccgttttgaccttcttggaaaaataatagcccggtaaaaaagatcccgactgcacttaaagacaagagaaaaagtaacttgagcaattttttcagaggcagataaaccaagagcagcaacaagaaaaataaagtcaaactgctatttagcaacaaattatcttgaaaagagacgagcaaagccagcgcggataaagtcagcagcttgactgttgggtttcggtacttcattggaagactcctttacaaaatgattgaaatcgaatgttcggtcacaaaaatctgacagaagacgcaaatcatggctaatgatgaagaccagtgtaccgctggccgctttgtctgccaataacgacatcaattgccaagactgccgcaaatcttgtccataggttggctcatcaacaagcaaaatcgggatctcacgatcgatcaaacaggcaacagctaatcgccgttgttgtccttggcttaataggaaaggagaatcttcctgtttctcccatagtcccaattggttcagcttttcagagagatcctctctttcttgaccattggctaattcttgtgccacggaggaagctagaaactgatcctgcgggttttgcatgacccagctcatccgatcgaaaggacgactgcgagaggtcaagcattgctcttggtaatagatcgttccatcatagggaacttgctgcaacagggctttaaaaaaggttgattttcctatcccgctttttcctgtgatgcctattcgttctccggtcgaaaagacttcgtctttgatcagcagagaatgtctgccaattggcaaacgaaaattttcaaaccgcaagaggggctgcggctcaataggaatgagggacggtttaatcatagtttgtcttagctgctcttcttgctctaaaagcaactgagaaggaaccgactgaaaagcatctgttaataggagccattcctgcacccagtcagcgaccggtgcgacttgatggtcgattaaaagaattccgattttctttttttgttgaatttctgttaatttttcaagcaatgattgggcggtcagcgaatcgagattagcgaaaggttcatctaatagaagatagcggctttctaaaacaagacagcatgctaacgctactagttgtttctccccacctgagagggttgtcagcactcgatcttctaaatgacgaatctcgcaaaaatcgagtgccgtctcaatacgacgagtcatttcgtttaatggaatggctctgttttccaaacaaaataacagctcttctcggggagttcgcatacaaaactgcgtatcgggattttgaaacatcaaactaacggacgcaatccgttgtacaggggataaatcagtaaaatctttctcatcgatcacatagtgtccagattcgaacccttgatccgacaaaccggctaataagcgaaaaaacgtactttttcctgaaccagaaggaccatagatccctttgatttccccaggatctaattcaaaggtagcggtaagtttttgctcatcaatcgtaaagacacaggagtctagtgctaaactcattctttcacacggcttcgtttgaagcaagtatgttgagcaatcggatagctattcaaaacccccatttttgctaagtgatcacaaaccactttaacaaggacagctgaaaaaaggagcgcggaaagcagacggatcacgaaaatagtcagcagtaattgccactttaaatcaagaaagctggaacggatcatgccccaaataaaactggtgacagtcgctcccaaagctcccaggatcaaagaagaccagccgaattttcgatagcgaaaagcggcaaagccagcctctgtgccgattccttgaagaaagccgctgacaaagataattggaccataaaagttacccatgaaaacctccaacaaagcggcgatcatttcagtaatcgtggctgcacctggttttcttagtacgtaaccggcaaatgcagacgccataaaccaaatcccaaagagaaattcattcgctagaatggcgaggccaaatggagttaacaaggtgctgagtaaaacccccaagtgaacggcccctaaataaacgacaccgaatacgagagaaacgatgcctaccatgatcacatcctttaattgccacttactcatgcaaagaggcctccttcaacgagggactattgactgaaacggttccttcaagaacataatgaggcagcttttcgtgtgcataggccagtgcttgttcaaaataggcgaataattgagcggctgtgccagatagcagcgtcacgtaatgggccgattgcggttgtaagcccatggcatccgccaacgagacgatatgcgcaatttcttccatataatcttcacgtccaaagacataaaaagaatatttgcactgaacgatgaacgtaccttttgcagtaatttgctgatgatttggccgttcatgcttgccgctgagaaaggcatcaccagccagatctcctggacagcctttcgaaaaagtgaactcaccgaccaaatgtgtttttgggtcataggcattgacaaaaagagctgctgccgcatcaatcacactggcagcttcaccacggtagagtgtactgaaaagatctgtctgctgccaaacggctgtggtatcggtctctttgatgcttcgaagaatgtgagaggcaaaatcatctttcattggataaagactgatgcggcatcccgtgatatcgatttgattcattgaacaattttccatagtattcttcctttcgaatgattttctgtctacaaaaaaagcgttcctccttttctatccacgggtagacagaaaaatgggaacgcgaaataagctgcgcaaccacttccctacgttggtattaaccaaatcaggttcaaagggaccagacaaactgtctatctcagcataaagcgcccctagtggataattcgattcaattactttctgagtgtagcacagacgatttgaaagaacaagtcagacagcgcgagcaaaaagacaaatgaatcactgcagatatgaaagaatagacatataaaaaacatctttttaggtgttgacagattgttttcccttgtgtaaagtaaataatcgaaagtaaaacgtaagtgttacgatttgtgaaaatcaaatcgtaacaggctctctggtgtttttttaggagaaatgatcgttttgctaaatcaaaaaggggtgctggtaaagagatgaagaaatttttaaaaataacaggtatttcgcttttaaccatagggttggctgcttgcagtgtgacaaaggaatcagcgaatgaacagacagaacaatcaagtgatccaacgattcaagtcctcgctagtttttatcctatgtatgattttactcgcaatgtggtgggaaatgaaggcaatgtcgaattgttgatgccggcagggacagactcacatgactatgaaccatcggctaaagatatggcaaaaatccaagaagcggatgcctttgtttacaataatgagaacatggaaatgtgggttcctgccattgaatctacattgaaagaaggagatgtcaccattgtgaaagctacggaggggatggtgttgctgtcgggtgatgaagagcatgaccacgatcacgagcacgatcatgaagaagggcactctcatgaattagatcctcatgtctggctagcaccaagccttgcaatcaaacaagtagcaagcattcgtgatcagctaagcagggcttatccagaaaagaaagctgcttttgaaaggaatgctgcggcctatttagaaaaattgcagtcattggatgattcttatcagtcagcatttaagaatgccaagcaaacgcattttgtcacccagcatgctgcttttggctacctcgctttggaatacggactgacacaagttccgattgccggactgtctcccaatgaagagccttcagcggcacgtattgttgagttgaagcattttgtagaagataccgggatcaagacgatttactttgaagaaaatgccaaagacagtattgccaaaacactggcaacagaagctggtgtcgatttatccgttttgaatccgctggaaggattgacacaggaacaaatggatcgtggggaagattacatttccatcatggaacaaaaccgagacgcattgatgctgactacttcacaagccaatgagaaagaagtgaaagaagcagagaaagaaaaaaccgtttataatgggtatttcgacgacgcagatgttcaagaccgctcactcacggactggaagggacagtggcaatcggtctatccttatttgaaagacggcacgctggatcaagtttttgactacaaagcaaaacagaataaaagcatgacggccgaggaatacaaagactattatacaactggctaccaaacagatgttgcagaaattacgatcacaggagatacgatggcatttacctttgaagatggcacaaccaagaaagcaacctatcaatatgtaggcaaaaagatcttgaattaccaagcagggaatcgcggcgtccgttatttgtttgaatcaaaagataacgatgcagccttcaaatatatccaatttagcgatcactcgattgcaccaactgattcccatcattttcacctttattttggcaatgaaagtcaagaagcattattgtcggaaatggatcattggccaacgttctatccgactgatctgtctggattagaaattgcacaggaaatgcttgctcattaaaaaaaagattgacaattactgctcttttcgtcaaagttaaactgatagaaaggagcggtatttttttggaaaaaacattgaaaaaattagcaaaagtaatcgatcacatgatggatcatgtcgcgttgttcggtggtccgagtgttgtcagtaatgatgatttagatcattacttagatccggttttttatttgattttttgtgcagaacaaaagacgaataaaagaatgctgacagacaaagagtttgtcgaatgggtctatacggaaatgatgcctcaagagattccttatgatttgaatttcctcccctttgctaaattagctattgaagatttttattattgcatgtataaagaacagcacatcacaaaagaacaataccaagagattatctttgttcttgcagaaaaacagcctgtgttttactctcgcatgtcaaaaccgcatttctggtcttcagagaagaaagcggcaatgctagagatgcttcatgatgtcgaaccggaagatcatgatttggttccgatcgaacatccctatgaaaatcaacgatcgccaaaaatcgtcccttttccaataaaaaaagttcctgaagctagcgaagaaagaatcgctgcatatcaaatccgtattgatttggaaggtttcaagccgccgatttggcgaaggatgctcattcctgcaggcattagttatgaacaactccataatatgatccaaattgcttttcaatggcaggattcacagctctacctttttcttgccggcaataattcaatcgatgtgccgaacacggaacctacaaatgcattagtgatcgaccatgatttccaaacctgccaaactctgacctacatttatgacatgggtgctgactggacccacaaaataaaaatcgagaaaatactgacggctgctgaagcaggtgaaacagtcacgcctgattgtctaaaagcggttggtgatgtgccaaacgaagagcaaccagaggaacaaagagaatcagtgaatgttgaaacaatcaatgaagaactccgggattactgggaatctgatccgtccgactaatttttttctcggaataagtgcaataatcgattcatacgatggtgtgacgaatctgtttaacagttcgtgacatcttttttgatcggtccttgtttgattaaggtgttgaccattcatgaactacatcaagttagctgatatagaaatactcatttctgtggcgacacgcctggtttgatacagattctaactttttaactctagagccaatgattcagcagattgattttcgagtacattcgagtacaatagttcgtaatgatactggacaagcgacgatgctctatctgctgtgaggtgcatctttcaatcgctctagaagatggactatctgttctggcgacagctgagagcaagtgaggggagtttttatgaaaaaacgagaatttatcgttcaagatttgcttagtaaaatttatcaggaagaatttattgaaggaaaattaccgaatcaaagagaacttgccagaaattatggcgtttcccgctttacgattcaacaagcaatcaaaaatttagaagaaatcggcatcgttcgtgtggtccaaggatcgggaatctttatccatgagaagtgggtcaaaaatcccatgatctttaattccttgacacggactccttacgatcggatccactccaaaatgatttctttgagtaaagcacccgctaccccagatgaacaaaaaatctttcagttagcagacaatgaagaagtttggacttttgaacgggtgcgaatcgtcaattataagattgaacagctagaaacgtcgaagctaccggtaggattatttcctaatgtcactcaagaggtagtagaacattcaattcagcgctatgttgagagttgcggatatcggatttcccactacatcagcagttataccccgattgcgacttcaatggcccagtcggcaatcttgctgtgcaaacgggggaccccagcgatgcaaatcacgaatcgggcaattttggaagatgggcgggtctatgaattcagcaacatcgtcgccatcgactatgcagtcacctatattcgacctttcgatcgagaaatccatcgttcacgcatcgattgatcggcagaggaagagccacaaatttcctagacgataaatcaaaaaaactcagagctctgattcaacaatttgagtcaggctactgagttttttaggattattatttaaggtgtgattagtgtaccatccggcgttctgctttgtgtccactcatgggggcggtaaacgaccggaaaatcagccgcagcttcttcatcaaatgtaataccgatcccgcttttttccattggatagaagaagccgcctttgggttggggactgccaacaaacacggattgggtatttgccggcaactcgattgtttcttggatcgcggcattgtgcagatggatattcaaatgcgtattgactgccaagccgactggactgatatcagaaggcgtatgccaggcaattcgaacccccatcgcatcgcaaaaatgagctagcttcaatgctggcgtaatgccgccaatctgtgatacatgggcccgcatgaaatcgatctgccgatttttgactagttcttgccattccattggattattgaacaattcacctgttgcaatgggggttgctgactgactgcgtaattgtgtcagccagtgactttggtcaggcggcagaatatcttccaagaaaaagagctgataaggttctgctgctttggcgaactgaatggcttgattcggatggaggcgttcatgaacatcatgcagcatttgaaattggttgccatatttttctttgatcgctgcgaacatcttcaaagtcgtttccatataatctgtctgatcaaagtaagagccggagattggttcttcgggtgtttgcagctggcttggattcccgccatagaacccgagctggcaacgaatatagcgataaccggctgccaaaaagcgatcgatttcgtgatagagatcgtctaaattatctgctaccgcatgagtataagcagggatcgcggttcttgcttttccccccagcagttgatacagaggcatatcagctaactgtcccttgatatcccataatgccatatcaataccagagatggcattgtttgtgatcggaccgttgcgccaataggaattgacattcatgacttgccagatgtcttcgatttcattcgcgtctctacccatcagaaggggacgtaaatattcgtcaacgactgttttgactgctaaaggacgaaattgaaacgtactacagcctagtccggaaattcctttattggtttctactttaacgacaacaaggttatggcgatcaggtttgatcgcaaaggatttgacgtcggtgatgatcgttggtgtcattttattcactccaatttttgtatctagttgatatagccattgaaacacgcagagcaaccgctgtcaatttggtccaaaaaaagatggctatggctcataaaaccagtccaattttagatggattcttatttatttgttgatacatagcctttttggtctgtttttttaataaaaggactggttttacaagcgggtgcagccatgctactatgtgtgtgaaaacggacccacttgaaaaggcgcctcaagattcaagtccgttagcaaacaacaggaggaaaaaatgatgatgaaagaagacatcgtaaaacagatcataaaagatgttggtggatccgagaatatcaataatgcttggcattgtatgacgcggcttcgttttgatttgaaggatgaaaagaaagttgactatactgctttagaaaaaatacctaaagtggtgggaacgaaatatcaaagcaatcagctccaagtggtgatcggtacagatgtagcggattattatgctccattagccaaagaacttggtttggatgaaaagagtcaagagtcttcagagaaaaaaggcgctgtctcgttgtttatggatacagtctccggtgtattcggaccaattgttccagcaatcgctggggcaggaatgattaaagggttgatggcaggattggttgccttaaatgtgatttccaatcaaacagatacgtatttagtcattgatatgatcgccagcggcgtatttaccttcttgccattttttgttgctgcttctgctgcgcgcatctttaaaacgaatcaatacttggcgatcgccattgctgcaacattacaatttccaacgatgacgaatgcagttgctgaaggcaatatttcggcctttcgactgtttggggttttaccagttcccgttttcaattatgcgggtaccgttattccaatcatttttgctgttttagcattaagctacatttatcgctgggtagacaaggtattgccgcaagttctgcggaccgtctttacaccgacgatttccttgtttgtggctggactgattacactgacagttattggtccaatcagtattcatttaggcaatttgcttgcagatggtgtagctggcttgtttacgatttctcctgtattggcaggaattgttgtaggtgctattcgtccaattgcgatctttaccggattacaccatgcaatgacgccaatcgcattacaaaactttgccaatcaagggtatgatatgttgatgccaatgatgttcatggcaaatatggcgatcaccggcgcaaccgcagcgatctactttaaagtaagatcaaaagaagaaaaatcaatcattttgtcctcagctgtgtcaggattgctgggcatcactgagccagcattgtttgggattttatcaaaatataaaaaagcatttttagcagctaccatcggtagttcgattgcatcagcgttcatcagcttttttggcgtaaggatctatggctatattttatccagtatctttagtttgccggcttatattggtgaatactttatctatgcggtcctaggtattgtcttggcgatcggttcctcttttgctctgacttatttcctagtccctaatcaagcagaaacagaaaccttcaccaacgaacttgatttgcatgttgtaacgcaaggagaatacattccattggaagatgtacccgacgaagtgttttcaacaaaaatgatgggtgaagggtatgccattcactctaaagacggccaaatctattcgccagtcagtggtgaagtcacttcggttttcccttccaaacatgcggtgggaatcaccacatcgaatggtgtggaagttctagtccatatgggaatcgatacagtttctcttgatggcaaaggctttgaagtattcgtaaaagtaggagagcaagtaaccccacaatcgaaactagcagcgatggacttgccttatatcgaacaacaaggcaaagaaacgatggtcatcgtcctaatcacgaacatggaacgtgtccaacaattttcaggaacgatcggtcttgaaggaaatcatcaagccggtgccctattagaaaaggtaattttaaacgcttaaattcaagaaaaaaagaggtttaacaagaggggagatgcacctggcaaaaacagctgcggcatattctgtccaattgttcgaaagaaagagctgcgacaagacttttgttacagctccttttttttaccatcagtgacgttgagtaatataggcagctataggtttactatatttctcaaaaagtttttgcttttcagaagggttctgaccttgattaaaatattcagccagtaaataaccgatatagggacctgtggttaatccagaagaccccagtccgctggcgaccactaatcctggctcactgggaagcagtccaaaaaatggcgcaaagtcagaagtataggcccgtgttcctacgcgaactgtcattggcgcagcaaacaatttctcgggggctgccaaaaatgaaccgatgccagtcagcaattgttgctttgctgcttcagtgggagtcagatcccaaccgccatcattttcgtgagtcgctcctaaaaggatcttcccattcgcaaaaggaatcaaatcgccttcgccttctaacatcgccactggccaatcttttgctgacgctgtcgtttcgaaggagagcagctgtcctttttggggacgaacatcgacgtggtagttcaagtgttctaacagttggcctaatcctggtccggcggttaaacaaacatgatccgctgggatttctgcgtatgtagtagaaacgacccaatttttttctttataaagtctagccttcccttggacgaaaacgaccccattggtacgggcccgttcttctaggaacgctagataagcagcgccatctagtcgacctcctccggaaattttcaaagccggtagtggtttgagcaaaggtaaagcttgctgcgtttcagcaggagaaagacaggtgatttgaccgatttccggtgcctctttgcgccgttcctccgccagttccgctaatgctgccaactgattttctgggcgaatgatcaatgtacctgagcgttgataaatatctgtggtcagtgagaaatcttgtgccaatttttcgaaaaaagcagccccatctttagctaattgataccatcgtttgtttcgccgtttcgaaagccagggggaaatgatcccggcactcgctttagtagcttgtcccgtagggtcgtcaaccacggtcacttggtacttcgtcgtatctagataatttgctaaggtcatcccaatgatgccgccaccgataattacgattttttccataaaactgcaaactccttttttgtttcaatcattgttccatattcttctcaaaaaatcaaagactgaaagtttctgtcgaaagtgattcccaaactgttcccatttcaaatgactggattttctcgtataatggacatggaaaagaggatattatgcaatcaatcaatcaagttttaagagataaattcggttataccagctttcgggaaggtcaagaatcaatcatcaatgccattctttctcatcaaaatgttttaggcatcatgccgactggcggaggaaaatctgtatgttatcagctcccagctttattgttagacggtctgacattagttatttcaccattgatttcattgatgaaagatcaagtagatgcattgaatgacatgggtatcccggccgcttatatcaatagtaccttatcagctccggaaatcaaccaacggttaaggcaagcatcgaaaggagaaatcaaactcctgtatgtcgctccagagcgtttggaatcagatcattttcgcgaattgctgcgctatgttcctatatccctactcgctgttgatgaagcccactgtatttcacaatggggacatgattttcgtcctagctatttacgcttagcggaaacgatccatagttttgatcagcggccaacggtggtggcattgacagctacagcaacgccaaaagttgcccaagatattgaacgactgttgctgattccaccagagaaccaagtgaaaacgggctttgctcgcgaaaatctatcttttgaagttatcaaagagcagaaagatacttatttgctgacctatttaaagatgaacaaaggacaatcagggattatttatgccagcacacgcaaagaagtcgaacgaatctatcgtttattgaaacaacaatctatcaatgctggacgctatcatggcggattaactgaagaagaacgtacgcaaaaccaagaagattttctttttgatcgtcttcaagtgatggtagcaaccaatgcttttggtatgggaatcaacaaaagcaatgtgcgctttgtgatccacgcccaaatccccggtaatttagaatcttattatcaagaagccggacgtgccggacgagatggtgaacctagcgaagccattttattatacgctccgcaggatttgcagattcagcagttttttatcgatcaatctgagtccgatattcagtatcgtcaaaatgaatacctcaagttgagagaaatgagtcaatatgggcatacacaaatgtgtcttcaacgttacatattgcggtattttggggaagacggtcccgattgtggccgctgcagcaattgcttagatgaacgagaacaggtagatatcaccgttgagacgcaaaaagtgttgtcctgtgtgaaacgaatgggtgaacgttttggcaaagcgttagtggggaaagtgttgaccggatcagcagatcagaaagtcacccaatggggatttgaaaaattgccaacctatggtttgttgaaagattggtcacaaaaagaagtcaatcaactcattgactacttaaccgcatcaggctatttagtcccttcggaaggacaataccccctgctcagtgtgtcagctgccggtgtagaggttcttttaggcaaggcaaaggtttaccggaaacaagccaaagtacgtcaattggtcgtcgatgacgaattgtttgaccaattacgttccctgcgattgacgctcgcacaagaacaaaacttgccgccgtatgtcgtcttttcggacaagacattgcgggaacttgcggagcagcagcctaaaactcctatcgaatttctacagatcaaaggtgttggtcaaaacaagttagataaatacggtgatgcgtttctggctgtgttgaaagaataccgagaaacaacagaaaaatagtgctgctttacgattcaggaaaaaacaaggagaaaccaagatgctgaagattcgttatgcgcaaaaaagggatatgacattctggttagaactagataatcatttgtcaaaagcaggattagcaaaaaagttccaagatcaacaggcgttgatcttgaccgatgaggaagaacctgtggggattcttcgctaccaattgttttgggataccattcccttttgtaccatgctggtggtcaacgaatcccagcagagaaaagggagaggaaggcacttcctccgcctttgggaagcagaaatgcggaaacaaaggtatgggatgtgtatggcctctactcagtctgatgagagcagtcagcatttctatcgaaaatgtggctacaaagatgccggtgggttgcttatggacgtaccaggttttgaacagccgttggaattgttttttgtgaagccgttgtcgatacagcctcagtctgtagaatcagaagaatgaaaaaataggagcgataggcatgtctttttttggaaaaatagatttcaacgatttatcagagacggatcgagcaatttatcattatatgtccagtcaaagtgacaagattccttatatgcgggtgagagaaatcgccatcgaatcccatacatcggcctcttctgtgatgcgctttattcgtaaattaggctatgaaagttttacggagtttcggtcgcatgctaagatgcctcaggttgaaaatgctgatatacttagcggaagcacgttattaagcgctgatcattttcctaaaaacattgagagtaaattgagacgagtggctgagaaactgattgagtgtgagaatattattttttatggtattggtgcttctgcatcaatgtgcgagtatgctgcgcgtcgattttcaactttaggctgtaatagttttgcattagtcgatcatacatatccgatttttgcaaaactaaaaaatacatctgataatatggtatttgcgttatctattacaggagggacaactgaaatcatagagttgtttaacggatttaaaaacaacccggactttacaacggtcgtaatcacaagcgattctgcaagcacactgggtagaatgagcgattttgtattagattattcggttgatgtgaagagaattaataagcacgaggatttaacaagtcaaattccctgtatgtttttgattgaagccttatcagaggctgtgcgccaactcattacatttgatagagattgaaattattcatgaccttggtacttcgtgtaccaaggtgcttttttttctaatttgcttctcgtgtaccgatttattagtaaatgcacgatgaatatcggactttttgtatactcaaggagaataaagagaggatgaagaatcatgaatacatttccagaaaattttttatggggtggagctgttgccgcacatcaggttgaagttgtgtggaatgttgagggtaaaggtgtaagtattgcagatgtgatgaccgcatgaggaaatggtatttccagagaaattacagatggtgttatagaaaataggtattatccaaatcatgaagctattgatttttatcatctttacaaagaggatattcaattgtttaaggaattgggtcttaaagtattgcgcacatctatcaattggacaagaatttttccaactggcgatgacaaagaaccaaacgaaaaagggcttaaattctaagatgatctatttgatgaattacttgcaaatggtattgagccagtcatcaccttatcgcatttcgaaatttcctttcacctatataaagcttatggtggatttaagaataaacaattaattcctttttttactcgttatgcggaaagtgttatgacgagatacaaaaacaaagtcaaatattggatgactttcaatgaaatcaataatcaagctgatggataacataatttacacacctggactaattctgcttttttatttgatcaaaataagacccaagcgaataaggaagagataatttatcaaggtgctataaatgaattgattgcgagtgcacaagttgttaagttaggacacaaaattaaccccaaatttcaaattggatgtatggtggcaaacgttccagtgtatccatattctagtaaacctgaagatcagatgtcggcacagaaagaaatgaatagacgttttttttatagtgatgtccatgctagaggagagataccccaatatgtcctaaagaaatgggatcggaaaaactattctattgatatctcagatgaagaaaagaagatattaaaagaaggtaaagttgattatatcggctttagttattatatgtcaggcactgccactactctggatgagaatggcgagttgatcaatgatttttcaaaagccaaatggttaagcaatccacatgtgaaagcaagtgattggggttggcaaattgatcctgttgggatgagatacactttgaatatccttgaccaacggtatcagatacctttgtttagtgttgaaaatgggtttggggcctgtgatacagtcgaaaatgatgaaattcatgatcaatatcgtattgattatatccatgcacatatagcagaaatgaaaaaagctgtcttagaggatggagttaatttgttaggttacacaccttggggaatcatagatatagtgagttttggttcaggtgaaatggagaagcgttatggcatgatttatgtagataaaaaaaatgacggaaaaggtacactaaagcggttaaaaaaagattcatttaaatggtaccaaaatttatcgcatcaaatggagcagacatctgatgattggtacaaggggtttcattaaggtacagaagccattaagctggtacagcaaccaaccttgatgaaacccattgaatatgaaaacgtttttatttatagtttgtttataatgttgataaaaaaaaacgtttttatgtggtgatgataatgaatacacgaacaacaatccgagacgttgcaaaagaagcaaatgtgtcaatcgcaacagtttcaaaagcgttaaatggcgttgatgttgttaaagcatcgacgaaagcaaaggtcatagcagctgcgaagaaccttcattatgtgcctaatcttatgggaaaggaattaaagaaaagtaggacgaaaagaatcggattttataccacaagtatcactggtccgtattttagtgttctgattgaatccatagcaagagaagttgaaaaacatggttacgctttaaatgtgtttatttcaatggaaaaagaagttgtcttgacgagtattctgggaggtgctgtagatggatttattggatttgaagatatgcttgatcaagaagatcttgagataatcagaaatgaatccgtcaatgccgtttttattgatcgtaatattcaagatcatacatttggtagtattgttttcaattccaatgaaagcgctgaatatgcaacatcttatctgatagcgaaaggccatcgtaatattgcattcgtcaaaggctttgatggtgtttatgatagcgatgaacgattcaagggatatcagcaagcactaagaaaagcacacattcctctaaagccgcattatctaatagaaggaagatttgaagaaaatttcgcatatcaatcgacagaaaaatttttgcataagcaaaaagatttaccgacagcatttctagcgggaaatgatcttagtgctatcggcgtaaccaaagcgattgaacatgcaggctatcatgtgccgaatgattttagtgttgttgggtttgatggaatcgagctgttgaaatattttcgaccgtctttaacaacaattgtgaacccaatcaaagaacaaggggagcttgcaacgcaacatttagtaaagctgatcaatggggatgtttcaggaaaatcctttgtattaaatggaagattggttgagggcgaatcagtatatcagtttaatagaaatgagtgatataaatgtatttgggaatagatattggtggaactacaatcaaatatggatttattgatgataaaggacaagtttattgtaagcagagtatcaaaacgatcgataatagacatcaattcttggtaaacctacaaacaattattgaagagagtcagaggcaagaaccaattgaagggattggaatcagcgcaccaggaattattgatcaacacggcacaatgattacagcaggagcaatcaagtccatctatggtgttcgtctaaagcaagaattacagaagataacgaaagtaccaattgttatcgaaaatgatgccaatgctgctgctatcgcagaacaatggattggccatgctcaagggattcccaattacatatgtatggttctaggaacaggcataggtggcggtattatttatcaaaatgaattgatcaaaggtgcccatggcatggcaggcgaatttggctggatggttattaaggaaattaatgaaagcgttgacatagaggcgatgtctttgaatcagcgtgcagcagtgattggtggtttatgttctcgttataatgaaataatgttaaagaaagattcaaagttcaaaccaatttgggatgcaaaagaaatttttgctaaagaagaggatgacgatattgcccacgacctcattcatagtttttatgaagatctatctgtcggcatattgaacttgatcagttgttttgatcccgaattggtattgattggtggtggcataagtgcaaacacgttatttttagagcgattgagctccaccatttcaaaaatgacagaaagacatcaaagtattcattatttagtgggaaaaacgatcgcacctataaaagcagctaaattgatgaatgatgctggcatggttggagcagtatatcaagtaaagaaactgattctaaatgaggcaacaataaactgaaagtgaggggaacagatggaaacttccgtgcaaaatgcaaaacgctctactaataagataaaaaagtggttctctgttttttttgaacaatgggaattgcaaagtatggtctggccaggaattatctttatgatcatttttaactttattcctatctatgggctgatcattgccttcaaaagatatacagtcatcgacacacttgaaacagcaccttgggtcggctttgaaaattttcagatcatattaaatgataaatttttttggggatcagttgtaaacacgcttggtatcagcttcttgaagctactgataggttttgttttaccgattatcttagcaatcttgatttttgaactcagacaaggtgtatttaaaaaattggtccaaacaatctcttacatgccttattttctatcatggattgttctaggcggtatgttgattaattggctgtcaacaaatggattactcaatacaatattgagtggacttggtttttcaatcaaacatgaaaactatcttttatcaacgaataaatactggtggattgcggtattgtcagatatatggaaaaacactggttggggtacgattttatacttagctacgttatctaaaattgatccctcatattacgaagcagcaaaaatagatggggcaactaggtttcaacaaattatgaaaattacattaccaatgctaaaaggaatcattagcttaaatttgattctgactataagtggattactgggatccaacttagatcagacaatggttttgatgaataatcaaaatcaagcgaaggcggaagtgattaattcatatgtatttagaatggggatagcgcaaggcgatttttcttatgctactgcagttggattaggtgtgtcaattgtatcagtaattttattggtatgttcaaatcaaatgaccaaacgactaaatgacaatacgtccgtattgtagaaaggagcgttgtatggaaaaaaaagtgatgaaaaaggatgtagatagtcgtttattcgacattttcaatattttgatcttaaccattttcaccttgattatcgttattcctttatggaatgtggtggtatcatcattcgcctctggaagtgttcttgctaaaggtgactttgtattctggccttctgaactgtcactagagaattatcgagcagtattcagagatgggagtatgttgcaagctttctttatttcagtttctaaaacaatctttggtgttttaacacatgtatttttctgtgccatgatggcttatgctatgagcaaagcaaatctgaaaggcagaaaattatattctgcgatgggtatcactacgatgtttttttcaggtggaatgattcctacgtacttattgtttagacaaataggtttgttaaatagcttctgggtttatattataccagcgctgttaagttattatgacgtcattatattaatgaatttttttagaaatgtacccgattcattagaggaatcggcaatgattgatggtgcaggtcattggcgcatttttttgcaaatatttttacctctgtccaaaccagctctagcaacaattgccttgtttaatggggtaaaccaatggaatgactttatgacagctagaatttttattactgataagctctttacccattacaaatgaaactatatgagatcattgttcaatcacagacacaagggatgcaaaacatcggaacggctgtggcagaaagtacaaccaaaggtgtccaacttgctacaatcgtggtcacaacgattccaattctgattatttatccattactccaaaaacatttcattgctggaatgatggtcggagctgttaaagaatagaaaaggggaaaacaaaaaatgaaaaacttgagaaatttagttttgctgtttagttcggtgttgttgctaggtgcatgtggagggggagaagataacgcaagtcaagaagcaaaggatgtagatattagtgagcgttataatctagataaaaatacgccagcatggcaattggataataaggaagaagtcacagaactgacatggtatgttaatgctgattggtggaatgatgaatggggaaatgatgtcgttacaaaaaaaatggaagaagatttgaacatcaaagtcaaatttatcaaaggtgatgatactaacttaaatacaatgttttcaagcaatgatatggcagatatcgtcacaatttttgattcaaactcacaagttgcgcaaaaagctgatagttgggcctattcattagatgaacttgcagataaatatgatccttattggcaaactgtagctgcaaaagacacattaaattggtttcaattagatgatggaaaaacgtatggatatcccaattattctaatacagcagaagattatgatagcggtttaattcctgctaacacaaactttttgattcgaaaagatgtatataaggcaattggtgagaataattttgaaactgcggatgatttcatagcgggaatgaaatctatcaaagagaaatatccagaacttgttccctttggtttcaatgcgttgggtgatggggctggatctttaggtgatgttttccaagactatttgggtgttgatctagaaacaaaagagggtaatttttataaccgtaatctagatcaagagtatttaaactggttaaaagtgttgcgtcaaattcatgaggatggaaatttgtcggatgatagtttttctgatgatggtacagcttttgaagaaaaagtgaaatccggtcaatacgccacaattatggctagtggtacagcacaaatgagtggttttttacaaagctggttagctgaaaatcctaatggtgagtacattgcaatcaatggaccacaaaatagtgaagggaaagagcctaaattaaatcaaagtggtattactggttggatgatcaattatattagtaaaagtgctaaagatccagctaaggccatgcaaatcttcacttatttacaaagtgaatacggcggcattctaactacttttggtattgaaggagagactttccaatatgacaatgatggtaaaattgaattactgccagaagtgcaagagatgaaagataatgattcagatcgattcaaaaaagagtatcgactaagtgagtttattttctttggtcatgataaatatcaatcaatggctagtgaaagtactcagacacctgccttgatacagccaagagaatggggagaaggaaaattataccctcattttattctagaaaatattgatcctagttcagggactcaagaagcacgtaatctctctgcaatcaatacaaattggtatacaacattagtctgtttgattcgctcttcttcagaagaagaatttgatcaagtaatctcttcatattcaacatttttagatcaaaatggttggtcagatattgaggcaattagaaacgagaaaattgctgagaataaagagaaattaggcatcgaataaaaaggtggtagtcagtaatgaaacaaatatttaatattgatggtgaagtatacagtttcctacaaaaaatatatcaaatgatgctattaaatctattaatcatcttttctagtttgccaatcatcacagtgccttgtgcattgattactggctaccagcttttaaaagaatacaatcagcaagaagttaccctaacaaaatacttcatgctgtttagaaaaaatctgattctttcattcaggttaatcatcgctttctgggtgatctttttcttactgtttcttttactagcattcactagaagaactatatttcaatttttgatattactttttattgcattttttattgtgtttctttcgaatgtattcattgtttgtaccagccaaatgtccattcggtccatagtggagttttcattagggataacgttaaaatacgtaggttgtaatattattggcttagcgataatgcttagtagttttgttttacctgtgtttttacctagattagcattagtatgggcgttatttggaataagtattcctatggtttttcaagttatgatccataagcaaattatgaagcatgtaactacaaatcaaatagaacaggagtgatccattgagttttgaatattacacgacaacagatgaaatgaatatgtttcagcttgaacaatctccgtttacacaaaataaaaatgagtttgaaatcaatgtcaatagccatcaaacttttcagaaaattgatggatggggaacttctttgacagattcttctgcatatttagttgataaatgtttatctgaagagcaacaaatcgcagtcatggaagcgttatttgattcaaaaaaaggaatcggtctttcaattctacgaaacccaatgggtgcatctgactatgcgcggcatatttatagttatgatgatatggaaaaagatcaaacagatgagaatctgattcatttttctatcgcacaagatgaagaaagtatcattcccctaacaaaatatgctaagaaaatgaatcctgaactaaaattatttatgtctccttggagtgctcctggatggatgaaagattctcaacaaatgattggtggaaaattgttgttgaagtattatgatacatatgcccattacttcaaaaaagtgattgacagttatcatatgcatggattagatatatatgcgattacaccacaaaatgaaccgttgtttgtgccaccgaattacccaggaatggagatgctggcggatgaacaagcaacttttgttgctaaatacttaaaacctttgtttaatgataataacattcggacaaaaatattaggctatgatcataactgggatagaattgattatccattagaaattttggataaggcagaagcggcctttgatggcatagcttggcactggtatggtggtaatgtaattaatcaatcaagagttgctctattttatccagataaagaaattcattttactgagggatctggaggagattggataccagcctttgaaccagctttcagtaatctaatgagaacagggatcaacatttttagaaatggtgcaaaatctatgacgctttggaatttagcgctagacgaaaataatggacctactgttccgggatttggaaaaagtacttgtcgcggccttgtaaaagtggatcaacaaacgaaaaactatgaattgacacttgattattttggtctggctcatttcagtaaatttgtccgccctgaatctgttcgaattgaaagctcgaatgatcggcatatccaaagtgttgcctttcagaataataataaatccattgttgttattttgtttaacgatagtgaaaaggatgcatctgttaagataacgatagatacttattcaatggatacaatctatttgtcagcgaaaactgcgatgacgattagagaaatatctaataacgaggagtaggcggaaaatgatctgtttgaatcgttatgtttctaaaaatcatgatgcggaaaatgggaaaatcgtctttgctggttcttctttaatggaagaatttcctttggaacaattgtttctcgataaagaaataattgtttataaccgcggaattagtggagcaacttctaaagactatcttgaaatttttgatcgattgatactctctatacaacctgtacatctattgatcaatattgggtcaaatgatctagcagacgagtgttttgaggatagtcacttattagatagctaccgccaaattttcagtaaattgaagaaaagtctaccacaatgtgcagttacttttattaagttttatccagtaaataccggaataatgcaagacgtttcaaaaaaacaaggcgagcaatggctactgcaggcttcaaagtatagaatcaatagccgtgtgattgaagcaagtgagaaaatcagcaagcttgccgattcaaatggatatgagacgattgaagtcaataatttgcttatagatgaaactaaacagcttgatactttgaataccaaagatggcatacatttaacagaagctgcatatagaaaaattttccctttgatatatcaacatgtggatttagtacgaaaggtgaataaagaagcatcggatggtaagaaatgaccattcgatgcttctttttatgaaacacattccaatctatgtaacaggttgatttgaaagcgatttctataggaatgtccttcaaacttacctataataaacctaccgataaaaaagcaaaggagtatcatcaatgaaagaaaaaatgatggatgcgatgcagaagttttcaaaagccatgtttgtaccggttctgattttgccaattgctgggatcttgattgccattggcaatgtttttaccaatgttcgtttgatcgaacgttttccatttttggataacccaatcaccacaggttttggcagcattctctctgcctcacttttaccgatcttaacgaatctcggcatcatattttgtgtagggatcgctcttggtctggccaaaaagaaaaaggcggaagcggcgtttactgcattactaggctatctggtgtttttatatgccatgaacaaatttatggaacttcgagggatgcttgtagccgccgatgcactccaaggatcaggacaagcactggttttaggggttcaagtcttagatatgggggtatttttagggatcatcttagggatcatcgttgcattgatccacaaccgtttcatcgacactaccttcaataatgcttttcaagtctatggcggggctcgctttgtcttcattgttttgattccagttgttgtattgttcgccatcctttcttcgatcgtatggccggtgattcaaacggggattgatggattaggcggcattattcaagaaacaggaaacttcggtatcttcttatacgggacgctagaaagattattgattccaactggactccatcatttgatctatacaccatttctatatacttcccttggaggcgtcgctgaagttgggggccaagtcttcgaaggggctcggaacatttactttgcagaaattgcggatccggcagtaaaggttctctcgcaaagtgtcatctgggatgcacgaggaatttcaaaaatgtttggcttacttggtgcctgtctagctatgtatcagaccgcaaaaccagagaatagagtcaaggtcaaagctattttgatcccagcagtggtgacttcctttattgctggggtaacggaaccgatcgaattttcgtttatgttcgttgcaccagttttgttcgtgatccattccgcattaagtggactgagtatggttgcattgaatatttttggctcaagagcgattggtccgaatggctttattgatttccttttgtataacttgccgttagggattgaaaagactcgctggcccatctatatcgccgttggcatagtatttttctttctctattatgctcttttccgctttttgattaccaaaatgaatttgaaaacagtcggtcgggaagatgaagggaatgaaacaaaattgtattcaaaaaaagagtacaaagagaaacggttagcaggagctggtgttggagtgacggcagaagtaatcccttcatctgtaccaacggactcgatttcagcattgatcacgaaaggtttaggtggagacagtaatattaaaacgattgacaactgttacacacgattgcgtttgaaactaaaaaatccagaactagtggatgagacattgctaaaagaagaaacccaagccaaaggcgttatcaagaatggtgagaatgtccatgttgtttatggattgactgtaccaaaagtacgagaagaattagaaaagtttcttggacgagaaggagagattgaatgatgaagaatttttcagtagtgattgccggtggaggaagtaccttcacaccagggatcgtgatgatgctgttagataatcaaaaccgcttcccattgagaaagctgacactttatgataatgatgaagcgcgacaaagaactttaggtgaagcattgacgatcttattaaaagaacaggcaccacagatcgaattttcttatacgacggatccgcaagcagcttttactggtgctgatttttgtatggctcatattcgagtaggcaaatatgacatgcgggaaaaagacgagaaggttcctctacgccatggtgtgttcggtcaagagacttgcggacctggcggtatcgcttatggtatgcgcagtatcaccggaatgttggaaatcattgattatatggaaacgtattcgccagattgctggatgttaaattattcgaatccggcagcgattgtagcagaagcctgtcgtgtgttgcgacctgacgcaaaagtgttgaatatttgcgatatgccagtgggcaccttgcgacggatgtcgcaaattattgataaaaatccagcagacttagaagttcgttattttggcttgaatcattttggctggtggaccagcatcaaggacaaagaaggcaacgaatacatccaacaaatcagggaatatgttgcacagaatggctatctcactcaagttgaagtggacacccaacatacagatcctagttggcaagaaacccacaaaaaagccaaagatcttttggctctgacaccagagtatttgccaaatacgtatttaaaatattacttatacccagattacgtttatgatcatatgaaagagcatcccgaatatacgcgttcgaatgaggtcatggaaggaagagaaaagcgagtcttcgaccatgcgaaaaaaatcatcgaacaaggatcggcagagggtatcgcatttgaaatcgatgctcatgcaacctttattgtggatctggcacgagcaattgcgttcaatacgcatgaacgaatggtcatgattgttgagaataacggggcaatcgctaactttcctgatgatgccatggtggaagttccttgtatcgttggctctgatggaccagaagctttggcacaaggcaagataccatctttccaacaagccttgatgttccaacaagtcactgtggaaaaattagtggtggaggcatatgtggaaaagagttaccaaaaaatgtggcaggcgttaaccctttccaaaaccattcctagcgcaaaagtagccaaagatctcttagatgatctggtctcagaaaatggtgattattggccgggactccactaaaatgtttcacatgctgagaaacatttctgatcaaaagatgtcactttgaaaaaccttacaacaattagtgttcgctaaaaagtctgaggatgacagaggagatagaggatctgaatgataaacgagagggagtgcatctgtggtgcagtagttgatggctgcaagctggatgtttgccaaccctcttgtcaatcattcggatttttttgctggaatcactgacattctaaatgtttatcaagaattcaaagggagatgagcaatggtctttttgtggggatcttttttaagtatgctaaaatagaaatgaattagcagagataagggagcgagaggaatgtttttagggattgatattggaacgacggcaataaaaatcggtttgttggaagaacggaaaatcatttatcaacgttcttttcctatttataccaaaacagaaaaaggtcgcacacagtctgcgtcagaaatcatagctgtacttttgaaagggatcacggcgattccctcctctttacgagagcaaataacagtgattgggttcagtacagcgatgcatagtctaatgccagtgataaatgagaaatttgaagaaatctatatttggtcagataatcaggctagccaagtgattgcagagtttcgtcaatcctcattgtcagaatcgttttatcggcagactgggacaccgatccatgcgatgtcgccatttgctaagttgcttcacttcaaatccgctggcggttttgatggcaagacaaaatggtatgggctgaaagaattggtgatgcttttatttaccggagctccttggatcgaccgaagtactgcatcggcaacaggcctctactcccttgaagaaaaaaattggagtcaagagattcttcactatttggacctttccattgaacagtttgcgccaatctgtgacacgaccgatcggtttcctattgctgcgtccgctgccgctcgctatggattgaatgaaacagtagagatcatgtgcggcgccagtgatggctgtttggcggcttatgcagggtatgtatcgactggaatcaaaaatagtttgacgatcggcactagtgctgctgttcgaaaggtgacggatcaaccggtgttcgatcagcggcaaaatttttgttattaccttaaagaaggtcaatatgtcattggtgctccgtcgaataatggggggtgcgtccttgcttggatcaaagaaacattggcacaagatcctgacactttctatgaaagcctcccaagaatcattgaagaaaccataatcggcagccatggtctgcgcttttttccgtttatcaatggggaacgggctccttattggacatctgatatcaaggcgtcttatcatggtttgacgattcaacatactcgggcagatatgattcgtggagcaattgaggggatgttgttgaatattggtgttttaaaagaaatggcagcaattaccgatgaagtgacgatcagcggtggcgttttccaatcgaaagccattgcacaattaacagctgatatcttgggcgtgacatgttatttgtcaccggcaaacgaaccaatttttggtctttatgatctttattttggtcatcgtttggcagcaagagaccacttgcagaccattacgccgaatcaaaaaacgagcgcagcctacgcgtcgctcgctgaacattattttgactagcagaaagggttgcggctgaagtatcagcgagattgaacaacaagattgaacgacctgaaagcaactgaatggcttcatttatcgagtagatgcgaagcgagccagccagatagcaggggtgatcctagatttttttggctattccatatgttgaagccccggactcttttagttgatttcggcagtaaatgcctctacgaggtactccattagcagtaaaagctttccgtaaaaactcgtatattggatgttctgcgtatcatatggtcgttcatcagtgacaccaaaagaaaaatttgctagttgatgggctcggtgttcaccattgccgcagaaaaggacagtggggatttgatgatcattcgctagttgcattttttctagcactttctgtgtctcccccgatttagaaatcgtgatcagcatactgatgttgtcgatattattactaatgataccgccggaatcagaagcactcaccagtaaagttttaataccattaaccaacatttttttatgaaggtattctgctatgataccagaaaagccagtggcataaatggtaatgaatttatcattgttttgagcataaatttctttgatcgcatcaatagaggctgcaatgccttctgtgttgatctgatagttaatggctgcttcagtggtcatttgacgattcagccgattttttaagaaataaagtaattccaaatagccggaaaaacctaatttttgtgctaatcgcaccagtgttgctggagaagtataaagctcttgcgcgatttttcgcaaagggacgccttcgattttgtccgtatgagacaccaaataagtgaggatgtgctgctcgctttcggaaatttttttcctttggtcaatacatttaagtccatgctattgctccttttcgtggtaatatcatcatacaatgaagagaaacagaaagtaaaacttttttctttatcctttttttaaacaaccttcttacaccgtcttcgcaagagaagatggataagtttggttgtttatttcattataagagattataatttcttatatagaaaaaacaaaggtggaatacaaatgacgaaaccctatgggactgttttgattaaagccgcgaaaatcatggattatcttgcggaagaacccaacaaatcgttgcaagagattgcagctgctacagacttaaccaattcaaccgcgttaaagattctcgaaacattacagctgatcggctatgttgcaaaggacaagcaaaaagaataccgcttaggatctaaactcgtcaaatatgccaataaaaatattcaagaacttgacttggtagagatcagcctgccatttttggaagaattgcaggaaaaagccgatgagacgatccatttgggggttttgacagcgaatgaaatcttgtatgtcaataaactggaacctcaaaatcaaaccattcgcatgtcgtcgaaggtgggaatttcaagacctttatatagctcagcgatggggaaagctgtattagcagaattcgatgagacaagctatgaagcttatttagatgaaacacctttacaaccttatactgagaacaccatcacgaatgttcttaaattaaatcaagagttaagagaagtgcgtcagctgaagatcgcttttgatgatgaagaaatggagaaagagattttttgtatcggcgcggctcttttgaaagatgaggaaattgtcggtgctttctcagtcagtctgccaaaataccgattgaccgagagctataaacaaacattgcttcaagaaatacgtgccacaaaagataaaatcgaagcagccatttgaaatacttttggaaaccccttgcaaaagaaaaaagaccaggtataataaagataagatttctttataataaaacttaatttccaaataggaaattaagaacggaggggtttatgaaaaaagtagagcgattatcaaagttaaaagcctgtggaatcgttgcagtcgttcgaggcaccacaaggcaagaagcgctggaagctagtcgtgccatcgtccgaggcggtattaaaggaattgaattgaccttcacggttccgcaagctgctgaagtgattgcagagttagtcaatgactatcaagaggaccaagaagtgatcataggagctggcacggtacttgacgcagtgactgcccgcttagcgattatggctggcgcagaatatatcgtcagtccgacatttgatcgcgatacagctgagatttgtaatttgtatcaagtaccttatttgccaggctgtatgacgatcactgaaatgaaagaagccttgaaatcaggcgcagacatcatcaagctgtttccaggaagtgcctatggtcctagtatcatttccgctttcaaagcaccattgccccaattgaatattatgcctactggcggagtcagcttggaaaatatgtctgagtggttcaatgccggagtggtcgctgttggtgtcggtggtaatttgttagcgccagctgctagtggtgatttcgagaaagtgacagcggttgcttcacaatatgtggccaagttaaatgacattcgaggtaactgagatgactagaattattaccttaggcgagattatgttgcgcttatcgactagttctggtgtacgcttggagcaaagcggacgttttgctgcacactatggcggtggtgaagcaaatgttgctatctctttagctaactatgggcacgacgtctcttttgcaagtaaagtcccggcaaatgatctcggaaaagctgttacccatcatttacgcaattacggagtggattgcagtctgcttctaagcggtggtccccggctgggaacttactatatggaatctggagtaggagaacgtgcagcaaaagtcatttatgaccgtgcagggtcaagttttgcggaaatcaagaccaatgaatggtcagaagcgatctttaaagatgtcgcacttttccatgtatccggcattacaccagcgttatccgagacgtggcgggatttgaccctttcacttgttaagcgtgcgaaaaaagcaggttgcaaaatcagtttcgatatcaattatcgtggcaaactgtggacgacaaatgaagccgccgcctttctaaaggaaatccttcctttggtcgattattgttcggcgggcaagttggatgcacaagtttttatggagattccagcctatacagggcaaggaaatgagttgctgtattattaccaacaaatgaaccagcgttatccgaatattgaactgttttattcgacaaaacgagaagtgctttccgccagtgctaatacattgatgggtactctttggcataacggccaatatgcagcttctcaagaacaccgcatcgatcctattgttgatcgagtaggcggaggggatgctttttgtgcaggcgtcctgcatggcattctaagtgggtattcctctcaggaaaccattgactttgctaccgcagcatctgcattaaagcacacgattcatggagattgtaatcaatttacagaagcggaagtagctgaatttttagcagccggatctggaaaaatcattcgctaggaggaaccagcatgcaagaaatggaaacccgttatacacacagcccagaagatattcgacactatagtaccgaacaattacgcaatgaatttttggtagagaaaatttttgtacccggaacgatccagttgacttatacccataatgatcgcatgatctttggcggagtaacgcctacggatcaaccattagagtttcaattgagcaaagagttaggcgtagaatactttttggaacgccgtgaactaggtgtgatcaatattggcggtgcgggaaccattgaaattgacggcaccaaagaagacatgaaaaagcaagacggatactatatcggaaaagaaacgaaacatgtagtcttttcttcaaaagatccaaatgatccggcgaaattctatgtatccagtgtaccggcacatcataaatacccgaatgtaaaaatcagtatcgatcaggtcaaaccaatggaaacaggtgaaggcttaacgctgaatgaacggaagatttatcagtatattcatccgaatgtgtgtgaaagttgccagttgcaaatggggtatacgattttagaaccaggtagcgcttggaatacgatgccttgtcatacccatgaacgccgtatggaagcctatgtttattttgattttgccaatgaggacacaaaagttttccatatgatgggtaaaccagatgaaaccaaacatttagtagtcgcagaagagcaagcagtcatttccccaagttggtcgatccattctggagtcggaacaagcaactattcctttatttgggcaatgtgcggggagaacatcacatacacagatatggacatggttcccatggatgagttgaaataataaaagaaagaaggatgaagatggatttttcaatggatcactttcgtttagatggcaagattgcattagttaccggcgcagtttatgggattggctttacgatcgcccaatctttggcagcagctggtgcaacgatcgtctttaataatttaacacaagaatcagtcgatgaaggcataaaaaattatcaagcagccggcatcaaagcccatggctatgtctgtgatgtcaccgatgaagcagcagtcaatgaaatggtcaaaaccatagaggaagaagtaggtgtcattgatatcttagtcaacaatgcagggatcatcaaacggatcccaatgttggagatgtcagccgctgatttccgtcaggtagttgatgttgatttgaatgcgccattcatcgtttctaaagccgttttgccttccatgatcaaaaaaggacatggcaaaattatcaatatttgttctatgatgagtgaacttggccgcgaaaccgttgctggttatgcagctgctaaaggtgggcttaaaatgctaaccaaaaacatttgttctgagtttggtgaagcaaacattcagtgtaacggcattggccctggttatatcgcgacaccgcaaactgcaccattaagagagatccaaccagatggatctcgtcatccctttgatcagttcattgtggcaaaaacgccagcagcgcgttggggagagcccgtagacttagccggtcctgctgtcttcttggcttctgacgcttccaattttgtcaacggacatgttctctatgtggatggtggtattttggcttatattggcaaacagcctgagtaatcctcctaagttcctgatttctaaaacaggcgaacttagcaatcaaaaaagctcctattcttcgcacatcctcaatggattttgcaaagagtagggggtttctttgtcgaattttccgataaaaaaatgaatgggagaacctcttctctgagaaggcggatcgtggttctagccaagttcgatcaagaagaagggggggagccgcttactaaagaaccaacagttagttttcttgcagctttgctctagtttttttctttatttgataaattttttagactattcaattgtcagtggatatgagtaaatagattaggggttctatcgattttccactaaatcaattgataggaggattaagatgaaaaaatggtttctagtagcaatgctatttatttgtagtgtctttgttagtacgcaaaaggcagctgcccaaacggagggctcgatcacagattcctcttattatcgcaacgctttaaccgagaagattcctgcagatcatgcttttattatgagaaatggtgaatcaaccacgatagaaaaagtgtctggagtcgtgaatagtgtagtgaccccaaaaagttagacttttatggagtggagaaatccactccttttttgtatgataagattaactgttagacagctgtttttacagcttctcgaaactgaaccggacttcgccaatttaatttctttttgatgcgtttatggnnnnnnnnnnnnnnnnattttagttgtttattttgtcgtaatttaatcatactagagaacgatatgttttttaatacctaaaataaaaatggggctgaagaatcaattctgattcatcagtcccataaattatagagccctattttcagtataaatctgaaaatagctgccgtgtttgtgttattcgtttgtaaagcgaatagctaatgatttctgcaatgtgaaagaggaggcttatttcgaacagaataggttgctatggaaagaatagcgagaaatttttcttcatgataaaatgaatgctagctatttctaaaccaaaacaaaaagtaaaagaagggataggtatcatgaatattgtggtattagcaggcggtctcagtcatgaaagagatgtatcattgtcttccggaggccaaatcgccatggctcttgaggaaagaggtcaccgagcattattgttggatttatatcaaggaaataacgagaagacatttgaatccgcttactcgattcaaaaataagaagagaatccttatgattattttgtggataagaatgaaccagatattgagaaacttatccaaaagaatagcaaccagaaaaatttgattggaaagaacgtagtagaactctgtctgaatgctgatttttgttttatcgcattgcatgggggtattggagagaacggaaaactacaggctttctttgatatttatggtattcgctactctggttctcattacaaaggcagtttattggcaatggataaagatatagctaaacaactaatgaaactgaatgacatccccacgccaaagtggcaaatctgggagcaaggacaagaagtgtattattctacaccttgtgttgttaagccaatcgataatgggtcaagcatcggagttgaaatcgttgaaaataaagaacaattttttaaggccttaaaaaaagctgaaaaatacaacagtaaagtgatgattgagcagaagatagaagggagagaattctctgtaggcgtacttggcgataatgttctgccagcgatcgaaataattccccaacaaggattttataattatgaaaataaatatcaaaaaggagcaacagaagaaataacgccagctgacatttcgagtgatttggcgacgcgattgagtgaaatgaccgtattagtgaacaaagttttgggcttatcaatttattccagagtagattatatcgttaccaaagagcttgatatttactgtattgaagccaatagtttaccggggatgacgccaaccagtttattaccacaagaagctgaagccataggaatttctttttcagaattatgtgagacaattgttgaactatcacttgaaagctggtacaaatagtcaggatgtcagcgattgattgaaggctccattaaaaaactgtgacaaaaggttcagctacactaagttcttcgaagcataatcactggataatggtatctctgatacatttttcctttggacctatagcccgcagaagtatgcttttcggatatttcgtttgttgaaagagtgatatcacagttttttatatgaaagttgatactagagattttttaaatcaagagacgtcagttgttggcaggttttggcaagcgaacgttgaaaatgatggtttcgtctttgctttctgccgagatatccccgccagatgctaacagaatctcttttgcaatcggaagaccaagaccagttccgcctgtggctgtagctcgggaagaatccatgcgatagaaaggttcaaagagacgtccgatcatctcttctggaattgtttttccacgattcgtcagccgaatgtgaatactgtctgattcgaccaattcaagaagtaaaggcgaatctggatagctgtagttgatggcattgcgaatgagattatcaaagacacgagctattttttcggtgtctactgttgcaagaacatttttttgtaagttgagttgccaatttagattcttttcttccaagagaggtaaaaactcaaaggtcagctgttcaagcattaaacttaaatcagtcgtttctgtctgcaaaacgatcgtggtcaaattgaagcgtgtgatctcgaagaattcactgatcaatagttccagccgttgggctttttgtaaagcaatctccgtgtaacgattccgcatcgcattggataattgtggttcttcttttagaagagtcagataacctatgacacttgtcagaggcgtccgcaaatcgtgggcgagataaacgatcaaatcatttttccgctgttccgcttctttagcggcacgttgatcttgcagacttttctcccgcagttgattcatttcctcttgaacatcaatcagatggctcgataaagtgatgcgtttggatggttcttctatcagttgagtcgtggcttggatcgtttcattcaaataaccgatggctttggtcatatagtaaatggtggtaccaaaccatatcagtaaagcgccaatcgcaacacaaaacaaccagcgatccgcaaaaaaacgtaagatatagtagataggttccgttccataccaagtccgggttccggcaataaagcgaatgactaatggaatcattacaaggaatgccagcaagattccagtggtgacgaagtattgggtcaagagctttcggatcaaaggatttctattgttcaatgatatagccgaccccccatacggttttgattaatttaggtttacgaggttcttcatgcaatttttctcttaaacgagcaatgtgtgccatgacagtattattgttatctaaatatttttctttccaaaccgcttcgaaaagtgtttcggaagagacgacggatccttggtgctcaaataaataaagcaatattttgaactcaatgggagtcaggaaaacttctttgccgtagagaatgcattgatgactgttgattttgagtatcaagccgtctttttcatattcttctactgttggagaagcagtggaatgattgtatcgctggtagcgccgcaattgggtttttacccgagccacaacttctaaaggattaaaaggtttggtgacatagtcatccgctcccaaactcaatccagtgattttgtctagatcctctcccttggcagtcagcatcaacactgggaaaaaatgggtcttgcggatctgctgtaacagttgaaaaccatcaatgtccggcaacatgacatctaaaacggccaaatcaatggcttctttttcaatataggcgatggcactagtaccatcataaaacggctgcacactaaatccttcgttttgcaaaaaggtcgtgactaagtccgcaatttctttttcatcatcaacaacgactattttttctgacatactctctcactccacctaaacatagtttcggattctcacatttccatacccccatcataccttacctggtaaacttatgcatcgttttctatttgatcctagcactgactcgtggaccgatccgacaaatcaactcattggttatagtttgtacttgctcggcagtatcgctccaatctgtcagaatttcaatttcactttcaattgggatcgtaggacaatggctcaagtctatcaaaagcatgtccatgcagatcaagccgatctgcggcaaggactgaccgcgataggaaagacaaaactcttgatttgatagagaacggggcagtccgtcacaatagccgatgctcacaacaccaacagttgtttcttgattcgcgacggcggtttgcccataaccgatcgcttcccctttggcaacgactcgcttagtgatcaactgtgctttgagggtcagaataggctgtaagcttactcgttgttttgtaggctcgttcgtatcactgagggatcctgtcaataaaatccccggacgcacataatcatagtttaagtctggataattcaaaataccataactgctttgtaagtgtgtgataccataagaaatctgtctctgatccaactctaggagaatctgatcgaagcaggcaatctgcttctgagtgcgaatcatactatcaggatttaagcgatctgccgaaccaagatgagaataaacaccactgatcgtcaagaagggcaaatcgaaaatcgaaagaatcgaatcgatagtcggtgttacacctaaccgatgcatcccagtatcgatggctaaatgacagtcaatcgctacttttctttgtgacaatgctacagcatgaccttcgctgatgatcgattgggtcaatgagtagcgacgaagttcttttatgcgttttggagaggtatatcccaagaccaagatggggcttttgacagcatttttccgcaatcgaataccttcatcaatcgtagccaccgcaaaaaaatcaattccggcttgttctaaaacaggagcaacttccttggcaccacagccgtaggcatcggctttaacgactgccatcacttttgttttcggtgagatgatccgctggatctcctgtagattatgcaaaagggctgtctttgagaattcttttacggcccttttaacgggcgttgtttgtttgtgtctaaaccatgagtgtttttgtcttaaaaagaggcaaatgaatccaatcgtcaagatcaaaacaaccaaatagttgattagattgttttgcagaatgctgattttttggctcaaaaagtgtgtgccggcaattgtataaggatgtaaaaggtaaagccacaaagatagctgtcctggatgcttccaagtcctgtggggatgccagcgcaagatcagcggaaataagaaaaagagtacaacaggcaagaagagatacatactgtcatgtttaggtatagaaaacccatgcaagtacgcactctcaataagcaatccgataagactgatcaaaaagaagagagctgttttggataaacttcttttctctgattgttttctgaccagcacacctaagcacaaaaacaatggtgtaaagaaaataccgttgcgggtaccatctaataggtggaacacagcagtatagaatggttcgattggtgtctgttggatcagtccaaaccaactatcaccacctaatccaatcaggtacaatccagccgcaagccagaacacttttttgaaggagacatgtatcagcaaacttgttaggagcaggctcccagtaatcaaagccggaaagtaccaaagatgataaagaatgccattgaccaaaagtgcttgtactaatgttccaactggtagatcgaagccgatcgtttgactatagagtgctaatggtaaaaacattagtgtggctaatagatagacttttagctgttttttgataaagttgaatactcgttgtcgcgaaggataactattggccacagcaagttctgcaaacacatagtaaccactgatcataaaaaagaaaggaacagctactcgaaaaatcgtcaatgtgattaggatatcgccttctggccataaatagtgaaggggaagacaatggatcgcaaccaccatcatggctgcaatcacacgaaattgatcgattcctttatttttcatgcgaactgcctcactgtctgagccaagtaatcatggtattcttccagagtccatttttgggcagtgatgacttggctatggggaagcccgacataacgaaaatgccaaggttcataactgataccggtgatctcttgtttatcttccggatagcgtagaataaagccataattcatcatctgctgcataaataaatcagcagcagcactatctcgaaaatgagggcagataagatcatcatcttcttgtttctttagtcctacatcaatggccagaccgatttgatgttcactgcaacctggcaaagcaacgaattgtttggtataagctaacccgttttcttttagagaatactcccacaagcgtcgctgttctttttccgtacgatacccatctaccagacgaatgtccttttctagtccggttgctcgtacgagtcgttcccattgttttgccacttctggctgcaagtaaacatcgtgatcgctaaaaggagctagcactaagtgcgggggctcttgattttttttcaatggatggtttttattgatcaattgtaatgtgttcatcgtttgtcctcctctgccagtgcaatcaattgctctactaatatttcgtaggataacccgacttccgccatcatagctgggtagcgggagtgcccagtaaatcccggcatggtgttgatttcgtttaaataaatcgctccttgattggtgacgaaaaaatcgattcgagccagacccgtcaatcccaagtttcgataaagcagctgtgcctgctccttgatctgtgattcaagcgcgagaggcaatggtgctgggacagtgatcgtggcgctgattaattggtatttctcttcaaaatcaaaaaaaccgtcgacaagagaaatcgcatcacaagcaccaatcgtcaattgctcatttcctaagatgccgcagccaatttcaatacccgctatcgccttttggatcaacacagtagaaccgtaagcaaaagcagtcgttaatgcagattggagcgctgttttgtcagttacttttgtgatcccttttgaagaaccggcttcattcggcttgataaagatcgggaatccatggtcttgaataaaacgatcgattgtggcaggatcgttttcatagcgggataaaagcaaagtgggagcactagcgattcccatggtatcagcaagttgatgcaagagccatttgttcatacataatgcggaggcagcgacatggcaaccaacataaggcaggttcattagttcaagcagtccttggatacagccatcctcgccatacttcccatgcaagactggaaagaggacatcagggacgattcgtttttctcctaatataaatccttggctagaaaaagtcagctggtgacagtttttgtgatcttctagccaagtatcattgcgaacattcgcgaggtttccttgataccaataccaatccattgttggtgcgatgccaatggtcattacttcatatttcagcgggtcaatagcttggatcacacttgctgctgaggctagtgacactgagtattctggagaattccctccaaataaaacggcaatttttttcatcattttcttcctttccttttttcttttaaggttacattcagtgtacctaggaaaagaaaagaaaatttgcggtcttcctgttgtctttctcgtatttttatgatgaaaatctaacgattttatgacaaagggcttgaagaaagcaggggaagctattgttagtgatcaaatggacaacaactcttggtacagaagtgcgttgaaggaagagctcacgcatgcaggaaagcgtacaaaaaaggaaccgagctgaactattttcaacttggttcctctgtattcatacgttagttctttggcgtagtgtgatgtgcccaattgaggcagctatagctaaagaagatacagttaagtgtgcaacagtagctgatcatcttttagctcagtcccactattttgatggaagagtgccatcaaatccggtaccgttaaggattgtttttcctcacctgcgatatcgacaacgattttgccttgatggagcatgatcaagcgattgccgtaacggatggcatcttccatatcatgagtgaccataaatgccgtcaactgctgttcttgaatcaactgatcagtcagtgccatcacagtcatggaggttttcggatctaaagctgcagtatgttcgtctagcaggatcagtttaggctgttgcaaggtcgccatcaatagtgtgatcgcttgccgctgtcctccggaaagcagcccaatctcagtcgtcagtcgattttcaagaccaagattcaagcgagctaacttttctttgaagaaggcccgatgctttcctttgacaccggaggaaaacccgcgaacctggcctcttttataagcaagggctaagttttcttcgactgtcaaacgaacggctgtccccatccgcgggtcttggaagacacgactgatttctttggagcgtcgtgtgactgaatgacgtgtgatttctttgtcacctaagacgatcttaccttgttctgttgggatcgttccagcaatactattgagtaatgttgattttcctgcaccgtttccaccgataatcgtaatgaaatcaccgctgttcatagtgagatcgatcccgcgaaggacatgattttcgttgatggttcctttttcaaatgtttggtgtaaatcactgatcgttaaaacaggtgtcgtcatgattgacctcctttggttttcggaagaaatttttgcaatccaagtttcgttcgaatttgcggcaatgaaagacagataaccaaaacgatggcagaggcaagttttgaatctgaagcttccacgttgaattcaaagacgatggccaggattagacgatacaaaatcgcaccaatcacaatcgtgatcaaacgaacccacaaagatttattgctgaaaaggacttccgcgataatgatcgatgctaatccgatcacgatcgttcctacacctgagttaagatcagcaaaaccattgttttgagctaagagggaaccagaaagagcaatacagccattggaaatcatatagccaattagtttcatattgtccgtattaattccgttggcttcactcatcgcgagattgtctcccgttgctcgcactgctagtccaatctctgtgcggaagaagagaaacagcaacaaaatcacgacagcagcaaacaggaggcctgtacaaatgactgcggtatttttcgttaagcctagtgtttgaaaccaagtaaaaacagtatcttcccctaacaaggcaatattgggtgcccccatgatccgatttgtaatagaatacaatccagtcatggtaatgattcccgctaataatgcgggaattttaaatttggtatgcaagatccctgagacaaatccggcagctaaaccgccgcaaaagcccaacagacttgccgtaaaaggggaaaggccattggtgatgctgacagcagcaatgccggctcctaatggaaagcttccctcagctgtcaaatcggcaatatctaagattcggaaggtcaaataaaccccgatcgctaataatgcccacaacataccttgagaggcagctgattgaataagtatgaaaaatgtattgattaaattcataaggtttcctcaaatcatttttaggtttttagtttcaagttagttttcatcatttcatcatatagcagcaaaattatagtagatagtagatagtagcaaaattactcaggagccacgatgctttctggatcaattcctaatgcagttgccattttctggttcacaactagctctagtttattcgctgtttctacaggtgttgtagcgggcttttcatctccatcaagaatttttgcagccaattcacccgtttgtttgcctagtgacttgtaatcgatcccgaatgtagctaaagcgccatcttccacttgctcgacagaaccagcaacgatcggtgttttggtttctttggctacttcaccaacgactgccgcagcagaagcaaaggtattatctgttggcacgtagataccatccacatctttagctaaactagtagttacttgttggacatcatttgtcgtgtttgctgtcaagactttgacgtctacacctgcatctttcaatgctttttctgccaaatctgcttggatttttgaatttgcttctccagcattatacataataccgattgttttagcgtcagggacgatactcaataacaattgaatctgtttatcgatagggaccatgtcagatgtaccagtgatattgcgtccaggagcttcattggactccgctaattttgcttcaactaaatcagtgactgcagttacaacgatcggaatatctgttgtttcattcgccaatgagacagcagctggtgtcgcgatccctaagagaagatcaggagaattttttacaagtttttcgctcatactcttcagattgtcttggctgttttgggcattttggtattctaaagtaaggttttcgccttctttatagccgccttccgccaaaccttctttgaatccttcataggcagcatctaacgaaccatgttccaccagctgcaagataccaaccgtttttttgccatcttcagtggcattgttggtattcccgcatgccgcaagtccaagtcctaaggtagttgccaataggccagttgtgatccattttttcattttcatcaaatattcctcctaaaaagtcttgatttaaacccaacggaacaaaaaaatccattcagacaatcgtctaaatggatttgaacttaccaaaattcagaaattcagtgcggccatttagaagattctctacatggctgctgttcacgttaaactgctctagccattatagatacaaacaaagtgttgtgaggtttgtatccacaatgttatgaatacaaactatctaaaatagctaaagtaagcaatattcagttgtggggatagcaataatttcatgattcttcctccaaacttgaattgttttcagtatagacgaaagttctaccatctgtcaattgaaaaacgcaatattctgaaaattttttttataacagataaagagatgtatgcaaatagtaaaataaaataaaaaagcagccagattaactaagctgctttgattaaataggtttagctttctttataataacggatcgtatttttaatttctcgaatactataaggaagatcatcagaaaaagcggcatcttgatcgatttccaatgaatcagtaaagatggcttcatattcctcaatacttaatttttgtcgctgatccaatagctgagtgtgggcttctttgtttaattgattttcataaccagctaccaaacgaccactgaaaaattcagaaacagccccagaaccataactaaaaagaccaatgcgatctcctgcgcttaaatgagacgaattttctaataacgaaatcagtcccaaatacagagagccggtatagagattgccgattctgcgactatagacgatggattcttcatagcgagccatcactcgttcctgctccgtttctacttcatcggcaaagactgctaacaatgcttttttccccatttttgtataaggaatatggaagctgattgcagcataatcgctgatgctggcttgattgcgttcacaatgagcttgccacacttttttgaaagaatcgatgtaaacttggttagatagatgcccatcgaccattggataagcgtggccgagaggacgccaaaaatcataaatatcttgagtcaacatcaaattgtcattttcaaaagttagaattcgtgggttagctgtaagcaacatggcaacagcacctgctccttgtgttggttcaccaccggaacgtaaaccataacgagcaatatcggacgcaatgactagaaccttgctttctggattggcttgaatatgggttttcgcaaattgaatccctgcggttgctccgtaacaagcctctttgatttcgaaagagcgggcgaaaggttggacgccaagcaatctgtgtaagactacagcagaggctttcgactcatcgattccagattctgtaccgacaatcaccatgtcgattgcctgcaaatcttcaggttctaagatttcttttgctgcactagccgcaaatgtaacgatatcgtgtgtttttttgctgactgccatttggtcttgaccgataccaatggtaaatttattaggatctacctcacgagcgtgagcgagatcaaccatgtctaaatagtaaggcggaacaaaaaaatttattttatcaataccaacgttcattatgacgctcctttgggtttaacttatgttataactatcgtttatacggtatcatatttttgtttaaaaatgaaaaaaattctattagaatttaaactttatttaagaatggctgattggaacagaatgcaaactcgtggggtattctttttttgtggaaataatgatatatttctgttggaggtggcatggtggaagaagttgttattatcgatgcacgaagaactcccatcggtaaataccatgggtcattaaagaaattttcagcagttgcattaggtactgctgtagcgaaagatatgtttgaacgaaatcaaaagatcaaggaagaaatcgcgcaagtgatcatcggcaatgtcctacaagcaggtaatggccaaaaccctgcccgacaagtggccctacaaagtggtctctcagtggacatcccggcatcaacgatcaatgaagtttgtggttctggattgaaagccattttaatgggaatggagcaaatccagttgggcaaagcgcaagttgttttagccggggggatcgaaagcatgacgaatgctccgtccctcagtcattacaataaagcagaagatacttacagtgtcccagtctcaagtatgacattagatggcttaacagatgcttttagtactaagccaatgggcttgacagctgaaaatgtggcgcaacgctatgacatctcacgagaggctcaggaccagtttgcctatcagtcacaaatgaaagctgctaaagcgcaagcagagaataaatttgcgaaagagatcgttccgctggctggcgaaacaaaaacgatcaccgcagatgaagggatccgcagtcagaccacaatggaaaaactggcttctttaaaaccagtttttaaaactgacggtaccgtaactgctggaaatgcttctacgatcaatgatgctgcagcattggtgttgttagcatcaaaaacctactgtgaaacaaatgatattccgtatttagcgacgatcaaagagatcgttgaagtagggattgatcctgaaatcatggggatctcgcctatcaaggcaattcaaacacttcttcaaaatcaaaaagtttcattagaagacatcggtgtgtttgagatcaacgaagcatttgctgcatcttcgatcgtggtggagtctgaattgggattggatccagcaaaagtcaatcgctatggtggcggaatttctcttggacatgcgattggtgccacaggagcccgcttagcaacttctttggtctaccaaatgcaagagatccaagcccgttatgggattgcttctttatgtgttggtggcgggttagggctggctatgttgttggagcggccaacaattgaaaaagcaaagccgacggacaagaaattttatgagttgtcccccgctgagcggttacaagagcttgagaatcaacaaaaaatttctagtgaaacaaaacaacaactgtcacaaatgatgttagcggaagacacggcgaaccatttgattgagaaccaaatcagtgagatcgagctgccaatgggtgtaggcatgaatctgaaggtggacggcaaagcatatgtcgtaccaatggctacagaagaaccttctgtgattgcagcaatgagtaatggagccaaaatggctggtgagatccatacgcaaagcaaagaacgattgttgcggggacagattgttttttctgcaaagaatccaaatgagatcgagcaacggattgcggaaaaccaagctttgatttttgaacgggcagaacaaagctatccttcgatcgtcaaacgagaaggaggattgcggcgcatcgctctgcggcactttccagcagattctcagcaggaatctgctgatcagtcgacgtttttatcggtggatcttttcgtggatgtcaaggatgcgatgggagccaatatcatcaatgcgatcttagaaggcgttgccgcacttttcagagaatggtttcctaatgaagaaatcttatttagtattttaagcaatcttgctactgagtcattagtcacggctgtttgtgaagtaccgttttccgctttgagcaaaagaggtggcgccacggttgcacaaaaaattgttcaagcttctttgtttgccaaaacggatccttatcgagcagtcactcataataaaggcatcatgaatggggtggaggcagtgatgctggccactggaaatgatacccgggcagtttctgctgcctgccacggctatgcagcacgtactggcagctatcaaggactgactaattggaccatcgaatcagatcgattagtaggggaaatcacgttgccgttagctatcgctactgttggtggtgccacaaaggtcctaccaaaagcacaagcagcattggaaatcagtgatgttcactcttctcaagagttagctgcgctagctgcaagtgtgggacttgtccaaaacttggcagctttgcgggcgcttgtctcagaagggattcagaagggacatatgagtatgcaagctcgttcactagcgatcgctgttggagcggagaaagcggaaatcgagcaagtagctgaaaaactacggcaaaatcctccaatgaatcaacaacaagcgttacggtttttaggagaaattcgggaacaataaaaaacttgtttcaacggtagcaaatgctactgttgaaacaagtttttttgtcatagacaaattgatgagtgtttctagaagctgctaaagctcatctttttaagtacatcccaatacttttgggggctgtctccacaaagccaaactgctgataaagattttcagctggacaatcagcaatcaggttcacgtaagcttggggatctacttcattatgtatatggttcattatggcgctcatgattgattttgccaatccattgccttgatcttcaggaaggacagcgatgtctaggatttgataggcagtacctctgtcaccaatcaatcggcccatgccgactaaggtttgatcgctggttcttcgaacagtcactgcaaaaagactattgcttaaaccaatcttactcgcagctgttccacgaagagaaagaccgcaggcttttcgtagagttaggtattcagctacttcaggaactgtatgttttaggagatatttagaatcgttcatcatggtcctccttgatacagagtagagttgtttagtcctagggaatttgatcaataccctttagcagatggctttttggtaatgggcaaagacgtctttaaaagaaagagacgatgatagaaggattccaacaaatgaaacagccaaaccccaacagttgagctgttcgtttttttctatcatcgtctctttagcttaacgttcagttagtggggtattcgcatactcttcgatcaatggaatcacatccagcttcagtttgtacttacgagctaaggcaggttcaacagtgaattcgccaacttcagtcgctgatatagttgccaataggcgtttttctttcgctgtatcttcaaaaatctgcacattctcggcatttctttcaacagagaatttaggaaatgcagtcattttttcttcaaaagcggcaaaaccatccgttgtttccgctgcttccgtctgagattctgagactggttcggtagcagaggcttctggttgattgacagctgatgttgctggtaaccaataagcggcgatttcttccactagattatcactaaaacgatctaatagacctttttcttgtttttggattcgtttcacaacgattttgaaattctcgtctaaaggaactgcgattttttgttctttggtcgttgccgtttgcagttcaatcaacatttcctcacggtttttagggttgatataaacggtggtctctagtccaaaatttgcagctgtcttgtgttggatcgctgaaaataattgttgacgtgccatttcataagatggccgaaattgttgttttaacttggctaattgtttctttttcatattcttctcctctcaatcaatctcgattataaggaataatgacgaaaatgaacaggggttttcatgaaaaaatgaggaatttcttttgattatcagaaaaaatggcctttctttaaatgaaataaaagaaacagccaagatcatacccaatgagtaggggatgactttgactgtttctgagggcaacaacttacttctaaagatataccaggttcatcgcatagtgctcaaagcgtcgatttgctgatatttaggcatcaaaataaacgaatcatttttaccataggcgaccaagcaattttcccatagaaaaaagcttagcggcatcttcgctttttcagcaagcatttgctgatagtctgactgatcccattgacgtgcgggaaaatgttgaacgtagtcgggaaaaatcagaaatacaaaatcaggatgcaaggctcgcttgacggcagtgggcagttgatccaaacgtgtagaatccatcgggttttccctcattagaatcctgttgtatccggattagttgctttcccaacgactccatctagttggtcgattcgctgcatatcttcatcagaaagctcaaaatcaaagactgctaagttttcctcgatacgacttggtgtaacagatttaggcagcggcaagaaaccatgttgtaaagaccagcgaatcgcgatttgagcaatcgttttgccgtacttgtcagagagttcctgcatttcaggaacgtcaaagatctttcctgtgcctaaaggactgtaagcttccaataagacattgtgctcttggcaataagacactacttctttttgtaattcaccaggcgctaagaaaatctggttgaccattgggaaaatagtggctgtttttttcagttcttcgaaatgatgaggcaagaaattgctgacgccgatggctttgatcttcccagcttgataaagctcttccatcgcgcgccatgtctctgcatttgctgactgccaattgtcacggaatttcactggatttggccaatgaatcaagaaaagatcgatatagtcggtttgtaatttcttcaacgattcttcaaaggaagaaaggaccaagtcgtaagagtgattttcattccataattttgttgtcaaaaagatttcttctctaggaatgccactttctttaattgcttgtccaacactgtcttcatttttgtaaccttgcgcggtatcgatatgacggtaaccaacttccaatgcttttttgacagcagaaacagcaacgtcaccatttggtgtttgccaagtgccaaagccaagttcaggaatcgatacattgttcgataaagtataactgttcattttcattcctccatttctttgtttttagtttagcagagaagggatttttttccaatggaagatacttctgatcaaaataatgcacaaaaaagatgtaaaaaaacttgtgttttgaaccagtttttttgtacacttgagaaatggataaggagagagaatatggatatctatttaaagcgtgcgattatgcacattgtggatcgacaaacgggtgatcccgtatactcgcaagtggaattggatctgacaacggaatacatccgagattatttaacgaaaaaaattcaaaaattagcgacacctcagacaaagaccggccgcttgctggaggactctgagatggctagattcgtcaaacaagcgccggaagcatttgtagaaagcagtgaagcaatcctgcgacgctggtatgaagtttaccaacaaagtgaagatgcaccaagtgcggatgctttcattgttttgtatgaattagataccaaactgcaattagcatttttgaaggttaattatacagatggctacacgcactttatcgacagtactgaaacaggtatcgccaataatctgattttgcatcgagcacttttagctggcaaaacccaaaaagcagatgaaggaataacgatcgatgtcgagcagctgacttacgaattagtagagaaaaaatataccttctccggagaaaaatatttctatttctccacgaaagtgattgattctgaaccgctgccttctctagaagaaaatgtcaaagtcatcaaaaaggtagctgaaaaaattggtcaaaagtttgagaccccttcttatgatgtcatcgccgatgtcaaagaggctgtttacgatacaatagaagaaaatggtcagctgcatgtagattcgattgcccaaaaagtattcaaagataatattacggctcagatggcctttcaagaagaagtagcagaaaaagggtatatcgatcaagcccctatgctgcgagaggtcagagaaatttcagaaaaaaaatatggcaaacaaaagctaaaactttccaatggtatcgagttgatcgttccattggatgtctatcgagatcctaatttgatcgaattcatcaacaatcccgatggcacgatttctgtaaccatcaaaaatgtggaagaagtcatcaatcgcatataaaaatagctgccaggctcttctcaaggagtctctggcagctatttttatttattgttgagttgatccaaagcgggtttgggtacatcttcttgtgagacttcttcccaactgaggacacctttgcggggattgactaatagtttcagataagctccttctcgtaggggcttggagcggtgttcattcattttaacgatcttctcttcacctgattcattataagccgcttgttcatatttataaatatcttgagccacaccatcactggcaattgatgttgagtgggtaccgctggtagtgatttcggtgtagtaagcagtgccgccatagtaataacggtaggcaaagaaacagccgcctaagaaaacgccaaagacgatcaaactcgcaatgatttttttcattcctgttcacctcatatctattattctataaaaaagcagacccgtccaactattttatcaaaatcaaagcaaatcttagaaattttgaataaaaacggcgaacaatgaaggagacaatattcttgactttgactaaatttgacctataatagagataggtttaaacttacaaaaaataagtaagaaagaattttttacttttgtaaggaaaagtctataattgatagtagagccgatccaacggcgctacatctcatttaggagggaaattattatggcaaaacaacattatgatcgtagtaaaccacatgtaaacattggtacaattggacacgtggatcatgggaaaacgacactgactgctgccattacgacagttcttggtaaaaaaggactcgctaatccgcaagattacgcaagtattgatgcggctcctgaagaacgggaacgtggtatcacgatcaataccgctcacgttgaatatgaaacagaaaaacgtcactatgctcacattgatgctccaggacacgcggattatgttaaaaatatgattaccggtgctgcccaaatggatggtgcgattttagttgtatccgcaacagatggtccaatgcctcaaactcgggaacatatcttgctttcgagacaagttggtgtgaaacatctgattgttttcttgaacaaaatcgatttagtcgatgacgaagaattgatcgatttagtggaaatggaagtaagagaactactatctgaatataattttccaggtgatgacattcctgttatcaaaggttcggcattaaaagcgttggaaggagaccctgatgcagaagctgccatcatggaattaatggatacagtagatagctatatcccaacaccagagcgggatacagacaaaccattactcttaccagttgaagatgtcttttcgattactggacgaggaacagttgcctccggacggatcgatcggggaacagttcgggtaggcgatgaagtagaaatcgtcggtatcaaacctgaaactcaaaaagctgtagtgacaggcgtcgaaatgttccgcaagacgatggactttggggaagccggcgacaatgtaggtgtcttgctaagagggatcactcgtgacgaaatcgaacgcggacaagtattggctaaaccaggttcgatcacaccacatacaaaattccaagcagaagtttatgtattgacgaaagaagaaggtggtcgtcatacaccattcttcaacaactatcgtccacaattttatttccgtacaacggatgtgacagggaacattacattgcctgaaggaacagaaatggtgatgccaggtgacaacgtgaccatcgatgtggaattgattcatccaatcgccgttgaaaatgggacgacgttctctattcgtgaaggtggccgcacagttggttccggtatcgttactgaaatcgaaaaataaatcagtgtttcaacaaaaatgaagcagtgactagagccttttaggacagtcactgtttctttttctaaatttctttgtgattttattaaggattttagatgatggaaaacaaacctagtcagcaaataagtttcatagtaggatagaagctgacactaaaaagataggatgtttttccatgagaaaactgcgacgattttttatttttatagcaaaaatagctggagtcctgttgcttatcggcggactgtttttaggctataaaaattatacagctctaaagaaagtgtattcttatgaagaaacaatcgctgagcaaacagaaaaatatggcatcagcgactatcaggaattagcgatgagtattatgttgactgaatcaaaaggggaaggaaacgacccgatgcaaagctcagagagtgcttacgggaaacaaaatcaatttgaaaatgcccaagacagtatcgagcaaggagtggcttatctggctaaactgatcaaaaaatctgctgacatgaactgtgatctgtggaccgccgttcaagcctataattttgggacagactatattgattatgtagccaagaatggtggcgaaaatacgctagaactggcagagtcctattcaaaagaagtgctttctcctttgttaggaaatgataatgagcaaacctatcgttactgggggtggcagtcgatcacttataatggcggttatttgtatcacaatggtggcaatttattttatgcagatgtggtaaaattcaatcaatggaagataaaaatgggtagtattttgttttcttgaaagtctctgaaatcaagcaggtaaaagacttgaaaaaacaataaaatatgatagaatcaatatgagtgattctgtctaattattcgtcgcactgattctgattggtgcgattttttacctaatgaatacgggaatacttaccgaatggaggtgagtggatggcacgaatacctcaaacggtcattgatgatattcgagaacgaagcaatatcgttgatatcgttggtcagtacgtccagttgaagaaatctgggaaaaactattttggattatgtcccttccacaacgaaaagtcaccttctttttctgtggcagaagacaagcagatctaccattgttttggctgtggccgcggaggcaatgtctttggttttttgcaagagttagaaggattaagttttccagaatctgttttgaaagttgcagaaatcagtgatatccctttagatgagcaatacaagcaaaccgaagcaattgatgcaacctcttctcagcaaaatcaattgatcgcgttgcatgaaaaagctgctgaagtctatcatcacatgttagtcaatacggctgccgggcaaggcgcattggattatttgctggaacgcggattgacgatggcactgattgacgaatttcagattggttttgcgcctaacgagcgtgcctttttggaaaaagtttttttgaatgaaaaagcaaatgcggcattttttgcggatacaggtctctttgtacaaaggaacgatgggcaacttgctgaccgtttttatcaaagaatcatgtttccgattcggaaccctcaaggaaagaccatcggtttttctggacgctggtttcaaacggaacaggatgatagcaaagaccagcccaagtatttgaacagtccggaaacaatgcttttcaataagcgtgaagtacttttcaactttgataaagcccggcgatcaatccgaaaagaaggccaagtctttctatttgaaggctttatggatgtaatcgcagcgtggcaatcaggaattgagaacgggatcgcttcaatgggaactagtttgacgaaccagcagattgccaatattgaacgtgtcgctacagaagtcatcctttgctatgatggtgaccaggcaggaatcaatgcaacgaatcgcgggattgatcttttacaagaacatagccgcgtgaatctctccgtcgttcgagtccctgaacgtctggacccggatgattatgtgcgaaagtatggtacagaggcctttttcaaactggccatgcatggcagagaaacggtgtttgcattcaaaatggactttcatcgtgccaatcgcaatttggccaatgaaaaagaacagatcgattatgtccaagaggtcttgcaagaattacagcatgtagattctttgctagaacaagaccgatacttgacacaactttcaactgaatttcatattagtcgagaaacactacagacgcaattgcgtcagttaaaacagacgcagccgaccccaacgccttcaccgccagttcgtgaagcagtgagtgtagcaccaccgccaccacgacagcaacggaaaactcaggtagaaaaggcggaggaattactgttatatcgtctgttccatgacaatacgctgaatcctcgttttaaaagtaccggtgttgcgtttattcatgataaataccaacaaatctattttttatacgatgcgtatatggaaaccgaagagcaatttatcctagcaaaattcttggattttttgaaagatgaacaaatgaaacaacaagtgatcgagatcgctgatatcaaggcttctgaagaggggacggaacaagaattccaagaccttctgcaggtatttcgtaagtcgggcattgctgaagaaatcaatcaaaaacgaatccagcagcaagaagcacgacaaaaaggaaaccagcaattagagttggaattagcaattgcgatcattgatttgaccaaacggttgaaacaagctaaatagcgaactgaaaggggctttctttcatggcagaagaaacaaagaaaacatatgacaaagctgttgccgaatttatcaaagaaaacaaaccaaaaggacaagtcgtttatgacgaactaaccaatcatttagcgaccccttattctttagatgcagacgcaatggacaagctgatccaaaaactggaagactcagggatcagtgtagtagatgagaatggggagccttccgttcatagtttgaagagcaatgaaaagcagcaagcaacgcaaccacaagaagatctttccgctcctacgggtgtcaagatcaatgatccggtacggatgtatttgaaagaaatcggacgcgtacccttattgactgccgaagaagaagtagcccttgctttaaaaatcgaagaaggcgaccaagaagcgaaacaacggttagctgaagccaacttacgtctcgttgtaagtattgcgaaacgttacgttggtcgggggatgcagtttttggacttgatccaagaaggaaacatgggcttgatgaaagctgttgaaaaattcgattaccgcaaaggattcaagttctcgacttatgccacttggtggattcgtcaagcaatcactcgtgctattgccgaccaagcacggacgattcggattccagtccatatggtggaaacaatcaataaattgattcgaatccaacggcaattactgcaagatctaggtcgcgaaccgacaccggaagaaatcggagcagaaatggatctgccaactgaaaaagtacgtgaaatcttgaaaatcgcacaagagccagtttcattggaaacaccgatcggtgaagaggatgattcccatctaggcgattttatcgaagatcaagatgcgacaagtcccgccgaacatgcagcctacgaattgttgaaagaacaactggaagacgtactagatacgttgaccgatcgtgaagaaaatgttttgcgattgcgttttggtatcgatgatggtcggacacgtactttagaagaagtcggaaaagtttttggtgtaacgagagaacggattcgtcagatcgaagcaaaagcgttacgtaaattacgccatccatcccgctcaaaacaattaaaagattttctagaataaaactgagaccacaaagacttttccaagaagtatgcttggagaagtctttttcttgtggtttagccaactttcgtaggaaaagtaatgaacttaataaaaacgtaacgaagcaagtgttggctaattgctttgaatatgataaatttaattttgtgaatcatttacacgaaggtgaatcattttggtacagagagttttttcaccaaagccagtgaataaagggcaagtctataagtgtgatattctgtagtaaaatgaaacctttcaacgatgaacagatacctgccgaagcaggttcaaaataaaaggagcaaattcgaacaaatgatgaaaacatgtcctcaatgtggatttgaatcaattgatgcacaaaagaaatgtccaaactgcggctttgagtttgttaagtcggatgaggcaaatgaaaaagaagcccctcatacgaatgagacggtatccgaaaagaatccgcagcaaaatgatgatatccgctggtctgattttaaggatgttcccttaggtgaattaattgaacatttcgaagacaagaatgaaactgatgagtcaaagaacaatcagtcagaagacgacgtaaacgtgcaagagctgataacgaacccaaatatagaacagacacccgtttcaaaagaaacgctatcagatgcgtccgaaacgatcgaatcacagtcacttgaatatcagtcagcagaacaatcgatgcacagtggaaatgaaagcaatgaagtgtctggatcagacaaaggaatccaatcgatcgcagaaagttccgcagagcccaatgatttagtagattcagccgaggtccctgaagatcacgattcggctattttatctgcttatattcgtcaacataaaaattcagagatggatgaagatgcgacagatgttccagtgataccggaagtcacggacgataaagaggctcttcctctaacggaggaacaatctcaatctggattagaagatgaacaaactgatactgcagcgattactgaatcttcagaaagccctcaatcaacagagagtccgcaaccgaaaattgaagcagaagaaacaaagcttgccgaaattccagaaaaaacagcggtatctgaaaatacgaagagtaaaaccgatccactgcccaaaaataaaaagtcacgcaaaaaattctatgtagcggctgcggcgttggtacttgtttctgcaggtggctggtattattacgaagagaccgctcgtcaagaacaaattgcgacagcaagtgagctggaccagatcgaagcggatctagccgatttttataccgacgataaccaagaatttatcaaagcagacaaaacaactacgcaattgacggcattgactgatcgactagccaagtataaaacggaaagccgttacccggacttgttggctcagtctgaaacaatcaaagaaaagatggcgactctttcggaaatcaatgggtatttcactagtccagtgatcattgaagatcaattgcagaaggtttccttaaaagagccttcggcagtgactatgtcaaaaagaacagctgaaacaccattcgatcaattagtaaatcgggcgattgatcaagggcaaaaagagtatgcccagatcgaagaagtacgaaatgcagtcaaaagcatggttgctttgaataaagagggtgaactttctgacaaagtcacgcgaaaaagctacaatgatttagtgaagaagatcgatgcattgtcgattgcttctttaaaagagcaattgactgctgagatagcaccgattgattctgcactgaagaaaaaagaagctgctgagaaggctgctaaagagaaggcggcccaagaagcagctcaggcacaagcggaaaaagccgccgcagctcaagaaacaactacggctaacaatagccagtcttctgaagctgattatgtattatcgccgaatacaccaacgaataccaataatcaaccaatcattccagcacgtgaaagtgatttggcagactctagcaatccggcttggaattgggcgcctggtgtccaagaaaagatcattgcaaccgcaattgctcgcggctatgtcgttgaagggggttatacctttgagcgcgtacgaatcgtgaatggagaaggttactataatttttatgcgaccaacaaccaaggctccttgttgaaaggaaccggtgattccgcttttccaatgtatctctttacagtgaatgccaaaaccgggtatttccgtggaaatggaaatgatcatacgattcggtgatgggtgacacttagaaaattttcagcataattacattattgaatcaaaaaacagcttgtttctcctccggcttttcgatatgatggatgataatcaatcggaaacggaggtttttttgttgcagaaaattgaaagatatgaacagttcagtgatggagttattgcctgtattccaacgattctgggttatctaggcattggttttgcaatgggcgtcgtggggaaaggaatcggcttgacggtcattgaagtcctcttgatgtcgatcattgtctatgctggaagtgcccagtttatcatctgtgcccttttggctattcaagcaccgtttacttcgatcgttgcgacagttttcttagtaaacttacgccactttttgatgagtttatcggtagcaccttatttccgttctgcttcattagtgtcaggaattggcatcggcacattgctgacagacgaatcctatggagttttaacgacagctttgcaacaaaacaaaccaatcactacccgatggactcacggattgaatgtcatggcctatttaagttggatctttgccactttcttaggagcgttgttagggtcatatattcctgattctgaagcattaggactggactttgcactagtggctatgtttgttggcttattcctttttcaagtagaggtgcctttaaaaaagaagaccaagcagacggtgctggtgctagccgctgtggtaatttcattggtcctttttatgcgaatttcaacagctgaagtagccgtgattgctgccactttgattggatgtttgatagggacggtgacacatcatgattgattttgttatactgatgatagcttgtggtgtcgttacttggatacctcgggtgctgccctttttattttcgaagaaattagtttttcctgaaagattcacgatctttctaagctacttgcccctttgtattcttggggcgctgcttgttcaaaatctgttggtttttcgtgaaggacaatttccattacttaaagtcaaagaaaccgttgcttgtttaccagcgctagtggtcggttattatacaaaagatttgatgaagatcgttgttacaggcgtcatcacgatggcggcgattcgattctttttctagtaaatcatttctaaggagagaaaaaatgaaagacttattggcatccgtttttagcggattgatcattgatgagaatgatcaaaattactttgtacaaaaaaatggtctgacttttcgcttatcaaaagcagaaggagagcaccatcttggagaagctgtggagggttttggttatcagaatcaaaaacaagaactcgtaatcactacggagattcctaaaagccgccaaggacattatgctttcggaactgtcacggacagtcgtcgagatctaggcgtctttgtcgatattggtctcaaagataaagatatggtggtatcattagatgaattaccaacaatgcgggaactttggccaaagaaaggcgatcgcttgatggtcagcttgacagtggatgaaaaggatcgaatctgggcttctttagcggatgaaaagatttttaaagcattgagtaaacgtggttcagagacgttgaagaatgctgacattacagggacagtctatcgcttgaaacttgcgggaacttacttactcacagatgatttctacattggctttatccatccttccgaaagataccaagaaccacgtttaggagaagttgtctcaggacgagtaattggtgttcgcccggatggtgttctgaatttatcattgaagcctcgtgcttatgaagcaatttcaaatgatgccgctatgatcatgacattcttggatcgagctgcagatcatcgtattccttttactgataaatcgacaccagaagagattctgcagacattcggtatcagtaaaggccaattcaagcgggcgatcggtaccttgatgaaacagcgtttagtggaacaaaaagacggcttcaccatcaaagtcaaaaaatccaattgagaatgcttgtatcttttctcattctaatttataatgattacaatattatctaagagttgacgtctcttagattagaatcgttataaattagcgatgtatggaggcctgtatgaatacaactgctgctttaaagaagacaaaaaaacaacttcatgaatcaggatttaaattgactccacaacgagaagctaccttgttggttcttttggagaatgagaaagatcatttatctgcagaagaaattttcttttttgtgcgcaaaaaaagtccagaaattggactagccacagtgtatcgtacattagaaatcttaactgatctaaaaatcgtggacaaggtgagtttcaatgacggcgtttctcgttacgatctgcgcaaagaaggagcaaagcatttccatcaccatttgctttgtttagagtgtggcagtatcgaagaagtagaagaagatctgctgacaggtgtcgaagacatcgtagagaaaaaataccattttctagtaaaagaccaccgattgacttttcatggagtgtgtcagaagtgtcagacaaaaaatgcagcgaagttgagtgaagcgtaattgctcctcagctttttttgtggttgaactactatcatatcaagctttaatttgttatgataaagaggttgaaagtaggggggacgtgtatgaaagaacagatcatcgattatttgcattatctgacgattgagcgggggctatcccaaaatacccgtaaaagttatgagcgcgacctagagcagtaccttacatttttgacggaacagcacatcaaagattggcaggcggtggatcgtgtcttgatcctctcttttttgcagcaattgcagcaatcagggaaatcctcggcgaccattattcgaatggtatcaagcttgagaaggtttcatcaatttctccgtcaagaacgctttacggatcatgatcctatgcaacacatcgattccccaaaaaaacaacagaaactgcctgatacattgagcctttctgaggttgagcgcttgatcgagacaccggataccaaagaagtgttgggaatccgcgatcgtgcgattttagaagtgatgtatgctaccggccttcgggtcagtgaactgatcgggttgcaactgaaagaccttcatttaagcatgggtctgttgcagacgacagggaaaggtgacaaggaacgaatcgttcctttaggagatctggcgattcagtggatcgaaacttacttggaagaagcacgcccttttttgactcggaaacatccagaagagagtcatctttttgtcaataatcatggaaaacaactttctcgtcaaggaatctggaaaaacttaaaggccctcgtgcgcaaggcaggcattacaaaaaatgtgacgccacatacgctaaggcatagttttgccacccatttattggaaaatggtgccgatttgcgtaccgttcaagaattattagggcatgcagatatatccacgacacagatctatactcatattacgaaaaaaaggatgacggaagtgtataagcagcactttcctcgtgcctagaaatagaggaagacatggaagaaatcaatatcaaactagatgtctttgagggaccgttggatctgttgctgcatctgatccaaaaattggagatcgatgtctatgatattccaattgcagcgatcaccgaacaatatatgcaatatattcatgcaatgaaaagtttagagttagaggttgccggagaatacttggtgatggctgctacactgatggcaatcaaaagccagatgctgctgccaaaacaagagatcttgattgaagaaaacgatccttatgaagaagatccaagggatatgctggttgctcagctattggaataccgtaaatacaaatacgcagccgaacaattatccgaaaaagcggaagaacgaagtttatactttacgaaagatccgatggatgtcgatgcctataaagaaaaaagtgatgaattggcagccaaccggttcaacacgatcgatttattcttggcttttcataaaatgcttgaaaagaaaaagagtcggaaagtactggagacaaagatcacaccagatgaaagtaccattgatgaaaaaatggcgacgatccaattggaaatgcagcaacgaaatgccaaaaagggacgacgttttgattcttttttcaccaattacagcaaaacagaagtcgttaccactttcatggcattattagaattaatgaaaaaaggatatattcgagtagagcaagaaggaaactatgaatcgatcttgctttacccagcaggtaaaacagatgagtaaatatagtgaaatagaagcgattctctttgtcgtaggagatgaagggatcggattagaagaattaagctacttagtcaatagcaaaactgcggctgtctatcagtacttgcaagaattgaatcagcgttatgaagaaaatgaagattcagccttgcatattttagaagttgggaatcattttgttttgtccacaaagaaagaagtcgcaccgttattaaagaaatacgcagaatcgccaatgggcaactctctttcgcaagctgcgttagagacattgtcgatcattgcctacaagcaaccgatcacacgaatcgaagtagaagagattcgtggggtccagtccagcggctccgtacagaaattagtcgcaaaacgattgatcgaggaaaaaggccgtgttgatggaccaggtcgagcaattttatatggaaccactgaatacttcatggattactttggcctaaaatcattagccgaattacctgatattcaagcaatggaagacgaactcgaagaagatggaccagtggatcttttttatgatcgttacaaacaagaaggagactcataatggaacgtttgcaaaaagtaatcgcacatgctggaatcacttctcgcagaaaagcagaagagttgattgtggcaggtcgtgtcagtgtcaatggtcaaattgttaaggaactaggagtacaggtgagtgccaaagatcgcgtggaagttgacggtgtcccaattgaacaagaatcgcccgtctactatatgctctataaaccacgtggcgtaatctcagcagtaactgacgataaaaaaaggaaagttgttttagacttttttactgaagttccagaacgtctctacccaatcggacgattggattatgatacttcaggtttattattgctgaccaatgacggcgatctttcacaaaaactgatgcatccaaaacatgaagtggataaagtctatgtggcaaaagtgaaaggaatcgctgataaaaaacaactattgcccttgtctagaggaattcggatcgaaggcaagaaaaccgcacctgctcgctttgagattttgtcgacagacgctgctactcaaacaagtatcgtccaattgacgattcatgaaggccgtaatcatcaagtgaaaaatatgcttaaagcagttggtttaccggtccaaaaattgaaacgggaaatgtatggttcgttgacattagctgggttgcgccctggagagtatcgggagttgacgaaaaaagaagtcaatgaattaaaaaaacaagtgaaataaccagcacacagcaaaagatgcttaaaaaatttgtcaatcgagaatttttgtgtataatgaaacatgtattataaataaaaggttcgtcttcaggggcagggtgcaattcccgaccggtggtgatagtccacgacctacttcttttgaagtagctgaatcggtgaaattccgataccgacagtaaagtctggataaagaagatagagcgtatttgatttgcctatggtttttcaaatgccctctttttccctgtggaaaagagggcattttttactttgtctggcgccgacaagtaaggaatcaaggaaatttaataggttcgtttgaagaggaatcctgaacttaggaggatttgtattaatgaacaacaaaacaagaaaaatggtaacaatagcaatgtgtgcagcaatgggaacagtcttacagtttattgcgtttcccatcatcccggcgtttagctttttgaaaatcgattttagcgatattccagtaatgatcgtcatgtttttattcggtccttttgctggcgtggcaaccgcgtttctacgttctctcttacacttgtttctatctggtttttcaccagcagatctcgtgggagacacggcaagtttcttggcatcctgtgtcttcactttgccaatgtactactttttccgtaaagggatccatgcgaaaaataaattcgtgggagtggtcacaggaatcctcgcattaactgcttttatgagtattgccaatctatatgtcatcacaccattgtacctgcgcttctttggtgttacagcagatcaattccttggcatgtcattagcgcgttatgtcagcatcggtattattccttttaacttgatcaaaggagttatcgtcagtggggtcttcttgatccttcatgcgaagttgttgccttggttggctcgtaaacaaccgcaacattcaccagttggaaaataataaaaaagatcgtatgttgcttttgagcaaacgcgatctttttatttttctaacagtatcgcccgagtaggacactttttatatgcagctaagactttttcttgctgatcttctatgataaactgttgccgagcggctggttcttgagcaaataagacgataccatcttcatcataatcaaaaatatcaggggcacagaccgcacataatccacaagcgatacagcgctcaggaatgattttgcagcgttgagacatggaattgtttcctttctggaggtaagtatagacatatggatgcttttattttagcgttgtttcatcattctgacaagttgcgtccgtcaaccatttatcaaatactttacggcaaacgaacgagttcagtattgagttatgcttttttttatgatcgcttaggttactttcaagcaatgccgaatcttgaagaggatgaatttaataaaagaatcacggcgctgattgctgccaaacaacttgtagcagatgaaaaagggtttctccagacagttgcacctgcaacgcttactgaagtagagacactctgccgtcatttaaattattttcaattcggtcgccggggggaacagatgtggcgcttggtacagctgcttgttcaagcggctgcttttcaagaaatcagtaatcgatatattcctgtggagaacactcctatgttcacagaaccggttcggcagctgattcggcagcacccaaaattgaagcaggcgttgtttactgagctttggacagtcttcgagcagattccgggagaatttgccgactttttggcagggacgttgacaggacctgagcaaattggtcagactttttttcagctgttaccagataactaccaaaaaatgccttggaatcagttttttccagcggcagcgatccactgctttttatcagtggcaaagaagcaatctcctcttttagcagcagggttaaacccgttttatcaagaaaacctcaaccaaagcatgctgaagacccgtcgcttatttctcagcgggaagtcgattgaggaaatcatggcacttagacagatcaagcgaggaacagtcaacgatcacttgattgaatgggcgatcatcgatgatcagtttccttatcactattttgccacaaagcagcagttccctccattgtcatggaaattaccttatcacattcttcaaaaagaagtgccgctggattttttaagtatccgaatcaatcaaattgcacaaaagcgagggatcctatgttagaacaggcgctcaaacactattttggtcattcccattttcggacaggtcaaaaagaagtgatccaatcggttctgaatcatcaggatacattagcaatcatgcccactggtaacggcaaaagcttatgctatcaactgccgggttatttgctggaagggttggtagtaatcgtatcaccattgctttctttgatggaagatcaagtgtatagtttgcaaaaaaatggtgagagacgagcgatcgcttttaacagtctcttatcattcgctgaacgaaaatttgttcttagccatctacagcagtataaatttttatttattagtcccgagatgcttgttcaaaagacgattctccaagcattggcaaatagtagaatcgcattgctggtcgtagatgaggcacactgtgtttctcagtgggggatcgattttcgaccagaataccttcagctagctgcggtcaaacaacaattaaaagcaccaacgactctggctttgactgccacggcaaccgaacaggtggcacgagatattcaacaaaaccttttaggaaaaacgcatcaagtttttcgctatggaatggatcgcaaaaatattggactgatcgttgataaaagcggcgaagaaaaagacacgcttttaatgcattacttgcagcaattgtcaggtgcgggaattatttattgtgccactagaaacaaggtggaagaactttatcaaaaattacgcggcaagtattctgtggggtattatcacggtggattagccggtgatcagcgtaaagtccttcagcagcagtttagtcggaacgagctgcagttattgatcgccacaaatgcttttggaatggggatcaataaacaagatattcgctttgtgatccattatgatctgccggattcgttagaaaactatagtcaagaaattggccgagcaggtcgagatggcaagcaaagctatgcgatcttactctatcgtcctggagacgaaaccatccattatttctttcaaaaggaactaagtgcagaaagagaacagctggaaatgacgccgcaatctttgatgctttccccattgcaggaaaaatggcaagcaaaaatcaatgagcatggtgccaacaaatggtttgctattttaaagcaaaatgagtgggaaaaaaagcagcagctaaaaacgatgctcgaatacattcactgtactagttgtcgacggtgttttttattggctcattttgacgaagaaaaacaaccgcttgaccagtgttgtgatatcgatggtattgaaattcggcttgaccaaaaggaattcaagccgcaaagaaagaactcgtggcaggaacgtttactaaaaatttttaaagaaacaaattgaatcgttttttaaaagacagttcgattcaagctatgttataatacatcggaaggatattaggaggtaatacgagtgagcaagaaagacaaaaactataattcagaaaatcaagagccgtgggaacaaccaatttatgatacagaatatgaagattctgcctcacgatcacaacagcggaaacaaaaacgcgggaattcactctttttgacgatcgtcttagttttacttttcttgatcgttgcaattcctgttggcgcggggatttgggtcttaaaccgctcaaatgatacagcaactgttgcctcatcaacaagtagcagtacagttgccagcacagaatcatcgactgttgagtcatcgacaaaagtcagtgaatcatctacttccagcagtagttcgtcatcgtcatcatcatcttcttcctcatctgaaagcagtgagtctgaagagccagcgaacagtgaagcagaaggaaacaacacccagaacaatcagggaaatgcagaccaaggaacgacgaatcaaggtgcagcgaatcagggagaaaccaaccaaggaacagagcaatatacgactgttcaagctggtgaaggtccagaacaagtagcagcacgtacaggtatttctgtcgagactttgtatcaattaaacgggatcgatccaagtaatttcatgctttacccaggcgatacattacgaattaaataaaaaaccgctttggcggttttttttcttgaaagttaaaaggccgttgatcggtagttgttgagaaggagtaacaaatgaaaaaaatcaatattgccatcgatggtccagcttcatcgggcaaaagtacagtggcaaaaattttagctcagcattatggatatgtttatacggatacaggggcaatgtaccgtagtatcacttatttagctcttaaaacagggtgctcattagaagatgaaagcgggcttgtggcattaatcgatacttatccaatcacttttgcgccaactgagacaggacaagatgtttttgtagatggaacaaaagtgacagaagagattcgccagcccgaggtaaccaacgctgtttccaaagtttctgcttatcaaaaagtccgggaaaaactggtccaacagcaacaaaaaattgctgaaaatggcggtgttgtaatggacggccgcgacattggcaccgcagtcttacctcaagcggaagtaaaggtttttctcgtggcgagtgtagaagaacgagcagaaagaagatacaaagagaaccagcaaaaaggaatcaccacctcctttgacacattaaaaaaagaaatcgagcaaagggattatttagattctcatcgagaaatctctcccttgaaacaagccgatgatgcagttcgcattgatacaacaggaatgtccattacagaagtcgttgcagcgattcagcaaatcgttgatcaaaaaatggaataatcaaccactggcgctagtcgacctaaaaaaacagaaccgaacgattctcatgagaaatttcattaaatatcggaattttcgcgtagaaatattgttcgaactctggggttttttaggtcggaggggctatttttttttgtatgaaacagtgattttgaagcaaaatagtgaaggaaacgttttttgagaacaattattgacagttttttgtgaaaataagcgaaatcgctttatttttttggcattctaatttaaactaagggatgtagtgcatttacgtacaattgttggttaggaggacacaagacatgacagaatttgaaaataatcaagtggagaatgggaatgaatcaatggaagctgctttggataacttccaagaagtgaacgttggcgatattgtcaaaggtgaagttttagccatcgaagacaaacaagcgatcgttggcatcgaaggagcaggtgtagaaggagtcgttccagcaaaagaattgtctacattgcctgttgaggatatcaatgaagtagtcaaagtgggcgatgttttagagttagttgttatttctgcaatcggtaaagataaagaaaacggcagctatctactttcaaaacgtcgtttagacgcgaagaaagtttgggaagatatcgaaaaagatttccaagcaggtaagatcattgaagcgcctgtaacaaatgtagtcaaaggtggcttagttgttgatgttggcgtacgcggatttgtgccagcttcgatggttgaggaccactttgtagctgattttgaagattataaaggcaagacactcacctttaagattgttgagatcgaaccttctgagaaccgcttgattttatcccataaagcagtggttgaggctgaaaaagagaaacaaaaagaagccttgctagctgatctttatgaaggtcaagaaatcgaagggaaagttgcacgattgaccgattttggggctttcgttgacttgggtggaattgatggtttagtacacgtttcagaaatttctcatgcccatgtaggcaaaccgagtgatgttttatctgttggtgatactgtcaatgtccgtgtcttatccgttgatccaaataaagaacgcgtatcgttatcgatcaaagatacattgcctggaccttggagcaatatcgaagaacaagcacccgttggtagtgttttagatggtgtagtaaaacgactaactagttttggtgcttttgtggaagtcttccctggtgtagaaggattgatccacatttcgcaaatctcacataaacatattgcaacgcctcatgaagtgttgcatgaaggtgatcaagtgcaagtgaaagttcttgaagtgaatccaaccgatcatcggattgctttgagcatcaaagcactagaaaaagccgaggaagcggaagaagcgcctgcagaagatgactatgaattaccagaagaatccactggttttaccatgggtgatatcttgggcgatgcgttgaaagataacgacgaagaataatctagtctagcagcttataacgattcgttttttgaatttgttataagctgcttttttgtttgtcatcaacacttgcaagttagtgatgcattaggtaaactaagaaagattgaaaagcagaagcagctgtattcagcagtttgcttcttataaatggagggtaaaaaatgtcaaatccaacaattgcgatcgtcggacgtccgaatgtcgggaaatcgactattttcaaccggattgccggagaacgaatctcgatcgttgaggatactccgggtgtgacgagagaccgaatttatgcaacaggtgaatggttaggtcgagagttcagtattatcgatacaggtggaatcgacttaggcgatgagccgtttatggatcaaatcaaacatcaagcagaaattgcgatcgatgaagcagatgtgatcgtcttcattacgagtgccagagaaggtgtgacggatgcagatgaacttgttgctcgccttttgtataagagcaataagcctgtgattctagcggtcaataaagtcgacaatccagaaatgcgtgcagatatttatgaattctatacattaggattaggtgatccgtatccaatatccggcagtcatggattagggatcggagatgtgcttgatgaagccgttaagcattttacagaagaagcagaggaagaggatgaatcgatcatcaaatttagtttgattgggcgaccaaatgttgggaaatcttcgttaatcaatgcgattttaggtgaagaacgtgtcatcgtttcggatatcgaaggaacgacccgggatgcgatcgatactcattttacaagtgaaaatgggcaagagttcactatgattgatactgcaggaatgcgtaaaaaaggaaaagtttacgaatcaacagagaaatacagtgtcatgcgagcgatgcgtgccatcgaacgttccgatgtggttctaatggtcttgaatgcggaagaaggaatacgtgaacaggacaaacgaatcgctggctatgctcatgaagctggccgtgggatcatcctagttgtcaataaatgggatctgctaaaaaaagaaaccaataccatgcgagactttgaagcggagattcgtgatgagtttcaatacttagattatgccccaatcatctttgtatcagcggcaacgaaacagcggttgaatcagttgccagctttgatcgaagaagtcagcatgaatcaaaacatgcgtatcccttctgcattattgaatgatgtgatcatggatgcagtagccatcaatccaacgccaacggataaaggaaaacgattgaagattttttatgcgacacaagttgcggtcaagccaccaacatttgttatttttgttaatgaagaagagttgatgcatttttcttatgcgcgctttttagagaatcagatccggaaagcatttacttttgaaggaactccgattcgaatcattccaagaagacgaaagtagcgattttatcatactttgctgcttttgacaaagaattctattcttttgacagaaaaacgataaatcctaaaaaaaacagtagtaaaaacgttaaaatccttgatattacaacgttcttatgataacgttatatcagaatattgatggatatcaatatttgacaaaaaacttggaccactcaagatttttgttgatgtatgacatcaaaaaaataatcaggaggtgaaaccatccatggcaaataaagcagaattaatcgaaaaagttgcagcagctactgacttgacaaagaaagacgctacagcagcagtagacgctgtcttctcaacaattcaagacgctttagctaacggtgaaaaagttcaattgatcggctttggtaactttgaagttcgttctcgtgcagaacgcaaaggacgcaacccacaaactggtgaagaaatcaagatccctgctagcaaagtacctgcattcaaaccaggtaaagctcttaaagacgcagtgaaataattgagtcttccaaacccttgagtaatcaagggtttttttgtacataaatttacttatccctattttcatcaaaaatccaatgtagatccgtctactaaaagtacatttatcggagcaattgcaaaaaaattcagaaaatttattgacaagaattttttttcgcgctatattattaaacaattacaagaaaacagcaaatattttaatgaaggagccattttttatgcgcaattttaatcaatatttattagtcattattattgagaccaggacttagaacacggaagcaaaatttatccgtttgtttgagtcctatttgcgtaagtaaaatgggattctggcaaagcatcccagtttattataaaccggggtgcttttttttatgaaataggcgggagatgatggaattgagaagtgatcagataaaaaaaggcattgaagcagctccagcaaggagtttgctttatgcaacaggacaagtaaaaaatatccaagatatgaataagccttttattgccatttgcaactcgtatatcgatatcgtacctggtcacgtccatctgcgagaactggcagatattgccaaagaagccattcgagaagccggggggatcccttttgaattcaatacaattggggtagatgatggaatcgccatgggacatatcgggatgcgttactcattgccaagtcgtgaactgattgctgactcagctgaaacagtcatcaatgcccattggttcgatggtgttttttacatccccaactgcgataaaattacgcctgggatgatcttggcagctatgcgtaccaatgtgccagcaattttctgctctgggggacctatgaaagccgggattgatcctaggggccatcagacgacattatcttccatgttcgaagcagtcggcgcctttaaagagggcaaaatgtcacaggcagattttgaattcatggaaaaaaatgcctgtcccacctgtggttcctgtgccggcatgttcacagccaattctatgaactgtcttttggagattttagggttggcattaccaggaaatgggacgattctggcagtttcgcaagaacggcgggaacttgttcgcaaagcggcattccatctgatggatctagtgaagaatcaagtcaagcctcgggatatcgtaacagaagaagccatcgatgatgcgtttgctcttgatatggctatggggggctctaccaataccgtcttgcatacattagctattgcgaacgaaggggagatcgattacgacttgaggcgggtcaatgagattgccgaacgagttccttatctctcaaaaattgcgccatcttccgcttattccatgcacgatgtccatacggctggcggcgtctctgccattatacggcaattggtcgatatcaagggggcgatccatccagatcggctgacagtcacaggcagaaccttgcgggaaaatgtcgctcaggcgacaatcaaaaatgaagaagtgattcatccaaaggagaatccgtacagccctgtcggcggcttatcgatcctttacggcaatcttgcgcctcagggaagtgtcatcaaagtggggggtgttgacccaagcattcagctttttaaaggaaaagcaatttgtttcgattctcatgatgaggcagtagccgcgatcgacaatcatacggtccaaaaagggcatgtcgtggtgatccgctatgaagggcctaaaggaggtcccgggatgccggaaatgttggcgccgacttcgagtattgttggacgagggttaggcaaagaggttgcactgatcacagatggacgcttttcaggagccacgagagggatcgcagttgggcatatctctcctgaggcggcagccggtggtccgatctctttgatccgtgatggagatgacatcgtgattgatctgcgaaatcgctcattggaagtattagtctcagaggaagaattaatgctgcgtgcacaaacacgtccgaagtttcgggctaaagtgaagaaaggctggctggcacgttatacggcattagtcacatcagcaaataccggggcgatcatgaaaatcagcgaggaggaagtttaatggagaatatccagttgaatgaagtaactaggaccggtgcagaagtgttagtcgatagtttgcagaaacaagcagtagaactgattttcggataccctggcggtgctgtcttgcctttatatgaccaactctacgatgctgcgattccgaatattttagcgcgtcacgaacaaggtgctgtccacgcagcagaagggtatgccaaagccaccgggaaagccggcgttgtcctagtgactagtggaccaggagcaaccaatgtggtaacaggtatcgctgatgccatgagtgattccgttccattagtggtgatcaccggtcaagtagcaacagccggtattggcaaaaatgcttttcaagaggcggatattctagggatcacattaccgatcactaaacataattaccaagttagacatgtcgatgatttgccgcgagtgatcgcagaagcttttcatatcgctaccacgggtagaaaaggtccagtggtgatcgacttgccaaaagatgtcacgcttcagcggacagccgcagtcattgaactgccgattgagcgaaaaagctatcaacccaccgtctttccatctattttgcaaatcgagaaattgatgaattgtttaaaacaagcaaaacgtccagttgtcttggcgggagcaggggtatgtgccgccaatgcagccgaagaattgcgtctgtttgtcgaaacccatcatttgccgattgtaaccacgctcttaggtcttggattggtgccagcagatcatcccttattcttaggaatggggggcatgcatggcacgtatgctgcgaatatggcattatctgaagcggatttgatcatcaatattggctcacgttttgatgaccgattagcaacagccggcagtcaatttggacaacaggcaatcattgctcatatcgatattgatcctgcagaaatcggaaaagtcgttcaaacaactattccgatcgtggcggatgcgaaagcagctttgacccagttgctgcgctatcctgcggaggaattagattgcaaggaatggctcaatcgttgtcaaaaacggaaaaaagaacatccttatcggtatgaccgcgaggaaacaaaggaaatcaagccgcaaaaattgattgaagaagtgggacgcttgacgaaagaggaagccgttattgttaccgatgttggtcaacaccaaatgtgggtcgctcaatactatccttttcgatttcccaaacagctgatcactagcggaggtttaggaacaatggggtatggcatccccgcaggcataggggcaaaatttgcttgtcctgaaaaaacgatagtcgtttttgtaggcgatggcggtttccaaatgaccaaccaagagtttgctctgctaaatgattatggtctggatgtcaaattcattttgatgaataaccgctctctcgggatggtacggcaatggcaagaaacgtttcataatgaacgccgttctgcttctgtatttgctaaacagccaaattttggccaattagcagaagcgtatggcatcaatagtgtgcggatcgaaaccccagatcaattgaccaacgatttggccaatgcattgctagaacctggtgcacgactaattgaggtactgatctcgccaacggaacatgtgctgccaatgattccaccaggaaaagccaatcatgagatgataggagtttaaaagactatgaaacgtatccttgctgccatcgtgcataacgaagctggtgttttaagccgcgtcaccagtgtgttgaatcgtcgtcaggtgaatatcgaaagtatttcagttgggaccaccgaacagccggaattttcgcgaatgacgatcattatcaacgcagaaaacccactggagacagaacaagtgacaaagcaattgaataagcaaatcgatgtcttaaaagtttcagatattacagaagacccccatattgaacgggaattagtgctgatcaaagtgaacgcgccaacgactacacgttcggagatccaagctgtgatcgaaccatttcgagcccacatcgttgatgttgcattgaagactatcgtggttcaagtagcgggagactcagagaaagtagcagcctgtatcgacgtgttgcggccttatggaatcaagcaaatggctcgtaccggtgtgacaggtttcactagaggttaaatgcaagaacagttgcttttaataaaaaaagatttcggagggaagcatacatggtaaaagtatattataacgaagtgacagacaatttaggagataagactattgcaatcattggttacggttctcaaggacatgcccatgcacagaatttacgggatacaggacacaacgtcgtgatcgggattcgtgcaggaaaatcagctgagaacgcaaagaatgatggatttaccgtgcttccagtttctgaagctgtacaacaagcaaatgttgtgatgatcttagctcctgatgagatccaaggagaactttacgagaaggaaattgcgcctaatctttctgcaggggatgcattagcctttgctcatggctttaatattcattttgaggtcatcacgcctccaaaagaggtggatgtcttcctggtggcacctaaaggaccaggccatttggtgcgccggacctttagcgaaggatttgctgtccctgcgttgtttgctgtttatcaagatgctactggcaatgcacaagagacagccttgtcctatgccaaaggaatcggggctacaagagtcggtgtactagaaacaacgttcaaggaagagacggaaacagacttgtttggggaacaagccgtattatgtggcggactgacaagtatgatcgagactgggtttgaaacgctggtagaagccggctatcagccagaactagcctattttgaagtttgtcacgaaatgaaactgattgttgacttgatttatgaaggaggattcgccaagatgcgtgattcaatctccaatacagcagaatatggggattatgtctctggttcacgaatcattaccgaacaaacaaaagccaatatgaagaatgtcttgaaagatattcaaaacggcacgtttgccaaaggttttattgcggataatcaagctggttttccggaattcaaaaaaatgcgggaacaaaacgggaatcatccaatcgaaaaagttgggtcagaattaagaaaaatgatgccttttgttacgaaagattaaggaggaacagtgattgctggtatctgtcgatcaaatagaacaagcacatgaaagcttgcaatcagtcgtttcaaagactcctttacagcatgatcggtttttatccgagaagtatcaagcgactgtcttactgaaacgagaggatcttcagaaggtccgatcgtttaaattgcggggggcatattatgcaatcgcacagcaagatccggctatactgaagcggggggttgtctgtgcaagtgccggcaatcatgcccaaggggtcgcctatacctgtcatgaattgaaagtgtcggcggttatctttatgccgacgacgacaccgcaacaaaaagtagcgcaagttttgttttttggcggtgattttgtccgtatcgaacttgtcggtgataccttcgatgcttccgccgaggcagcccaacactatgccgaagaccatcaaatggcgtttattgatccctttgatgatcccgccattattgcaggccaaggaacattggcagttgaactgctggcagaagcaaaacagcgcaattattctatcgattatgttgtggcagcaattggcggtggcgggttgatcagtggtgttgcaacttatttgaaagcaaaacagcctacaatctcaatggttggtgctgaacctctaggcgccgcttcgatgcaggcggcttttgataatcatggtccgaccacattagagcagatcgataaatttgtagatggagcagctgtcaaaaaagtcggtcaattgacctaccagcatgcagctcagtacgtcgatcgaatagtagcggtagatgagggtttaatttgccaaactatcttggacttatacagtaaacaagcagttgtggcagaaccagcgggagcactgagtgtcgccgctctggaattgatcaaagaagagattaaagggaaaaccgttgtttgtattatcagcggcggcaataacgatagtactcgaatggcagagattgaggaaaagtccttgatttatcaaggcttaaaacattattttgtggtcaattttcctcaaagacctggggcgttgaaagaatttgttagcaatattttgggtcctacggatgatatcactcgatttgaatataccaaaaaaatcaatcgcggaacaggaccagtactgttagggattctgctaaaaaggcaggaagatctgcccccactactggcgcgaatgtcaagatttgatccacaatatattgatttgcgggacaatcaatctctctatactcttcttgtttgattttatgaaccaagcgttacgaaacaaacgacctttttaaaaaaaagaggtcgtttgttttttgatttcaaatccatggctttccctcatcctttcgctagttagtaggtgaaatggttgattcttgttataatagaagtaacaaatcgtagatggggggcggatgtatggaatttgtcttttctagaaaagaacagcagacgcaaatcttgtatggagaaacattgaatgctgttttacggacgcaggaaatttccaatgatcaagtcatcattctcacaaaccagcggtattatgatcgtttctctgaaaaactgacccgtttgtttttacccaaagaagtcagctggtatatttgtaccaatcaaatgtattgcaataattttacggaatttcaggcctttatgtccttcctaagccgcttttcgaaacaggagaactatttgatcgtgggtttcggcaatgaaggtgtgctggcgttaagtagttttattcactacacgtcgattctgactagcgatctttggttgatcccggtgtctttacgggcgttagctaaaagtgtcaaagaatctgcgatcattgttaagaaaccagatattcctgttttgcaaagtcccaatgtaccgcaagtggtcgtatacgatcaaacgattgctgaaaaacaaaaagatgggaagttggtggacttacttgtattgattcgttgcggactgctcacggatcaagcttttctgcgggaactctttcgcacgtttctgacagaaaaacaagtaaacaatcgttcgtttgcagcatatacagatcgggtgatccaagcctatcaagcaaacggtgcagcacttgaagaatatggacaagtctttacagatgctttttataagactgaaaatggacatttgctgtctgatgcaatgaaacttttttatggcctactctttcacttaatctggaatgttcaacaacagcagttagcagtcaaattagataagctttgcttgtggcttgaccaactagggtttcctttagtattgcctgaccaactatctttaagcgactattttcagcaagttctgctgttacagaaaaaagagaaaaaactgctttttttatcagaaattggtacaatagggggcagaaccagcgcattagaagaggatctcgtccagacaatgagcgcttaccaaacaataatcaatcagataagaggaacttagatggaaacatacagtgaaaaaatgttacaggcattagcagccgagaatttagctgatgcgcaattgaattttgcaaaagccctgcaatcagatcaaaatgaagtcttagccgaattaggagaagaattgatccaaatcggctttttagaagaagcaagagaagtatttgatacactgcaagaacgtgaccccgaaaatgaagaatggttgctatcgttagcagaaattgctatggaaaatgatcaaatcgacgaagcttttgattatctagatcgaatcacaccgcaaagctctttttatccacgagcgttattgatcagtgctgatctctatcaattgattgggatccccgaagtcagtgaagcaaaattattggaagctcaaaagctgctgcccaaagaatcgctgattcgttttgcactagcggaattgtatttttcaaccgaccgttatcaagaagcggcagagttttatcaaggattactaaaggaaaatatccaggaaatcacaggtatttccttattggaacggaccggagccgcattgagtatggctgggaaatttgaagaagccatcgaatatctggaagcaagtctagctgaggatcaaacagatgaccgtctattccaaaccgctttagtttacttacaattaaaagaaaatgagcatgcgattcgatatttgcagcagttgcgggcactgaatccgcaataccgttccttgtatctctatttagcagaggcattacaagaagaagagcaactggaagaggcacaaactgtcattgaagaaggaatccatgaagatccatttcaagtggatttttatcattttgcatcagaaaatgcgtatcggttgcatgacagcgaagcagccgaatccttcttattaaaagcccttgagacgggggaaaaagaagatgaaaccctgcttacactgagtaatctttatttgaatgaagagcgttggcaagaagctgtgttggctatcgagaagatggaagacaatgaacaaccccatgctctatggaatttagcacaggcttataacgcgttagaagagtttgaccaagcagcgaagttctatgaacaagcgaatgaaggattgcagcatgaaccagcttttatgaaagaatatggattgttcttaagagaagaaggacgattatcagaagctctacctttactgagacattatctggctcacgaacctggtgatctggaagtgcaatcgatcgtggaggatctattagaaagataggtgagggaaatgaacatcaatgtacaagaaaagaaaaaatttctcaattggttagtttctactgtatcattcagccgacgagaagtttcttgggttctgaactacctagcaaatcatgaagccattttgacaaatgttcatattgttgaaggggcgatgcagacagatcgggggttgagtgttcgcagtacagagattggcggcgagccatttgtgttgacgatccagaatcaaaccttttatgatatcgatcaaatttttcacgaaatcaggatgaattggaaacagccgctttatttagaatgtatctttccaaatccttgggaaaaaccactttatttagctgttctggaggacaatccttttgaacggtggaatgaccatgttgacgaagaagtacaaaaaaatgtgacagaatatcttgacaaagaagctatgcagctaaaaattgagaaattataccgccaaatcgatcttgctttggaaaatggggatcgggatgcttttttggaattatcggatgaagtcaaccgcttcaaactcgatcaaaaagaaaaaagtcattaataaagctattaaaaagcgctatgtgaagtaataaaaactagtggaacagaaaagaaccgcaagaaagaagaggactcccagcaccgagcgttcgtcgtttgcaacagtgtgcgggagaaatcaagtttcttgcggttttttctttataattagataggatggaagaatggggttatctttttgattttgctgccttgcgttgcaaaaatcgtgatttaggacgtaaataagtgaagccttccccttcgacttcatggacattgatcaccgacacgaacgcttgttgatcgaagtcggcaacgatccgtttgacctctgaaatttcccggccgcttactaccatataaatgatccgtttgttaccaccggaataggctccttccccatttaaaaaggtgacgcctcgttccaattcattcattaagacaggggcaatttcttcactatgattactgataacaatgatcccttttgctgaatagccgccatctaggatcgaatcaatcacgcgagcgaaaacataggaaaagattagcgtgtacatcatgcgtttcaaatcgatataggttaaggaaagcaatagaacgaaaacatcaaagatcaagagagaacgaccaatcgtgatcccaaagttcttttctaggatccgggctaatacatccacgccacctgttgtcccaccaactttataaacaacaccactgccgatccctgcaattagtcctgcgagtaacgcaacgatcagtaagtcatgctgcagatcgatcaataatggaaccgtctgccagaaacctaaccaaaatgaaagaccaaaggttccaatcactgtatagactagcgaacgtctgccaagaatcttacctcctagcaaaatgattgggatattcaaaatcagtgtactgtaagcgggattgatgtcccacaatgcgcgcatgatcaacgtgatcccagtgacgccgccttcagctaaatcattaggtatatttaaatagacgagaccaaaaccatagacactcgttcctagaacaattaaggcaatatcgcggactgtccgccacgaaaaaaaagatcgcatcctgtttcccccatttctaaatctcacaagtaccaatttagcacgaaatttggcattaaacaatatgagcaagtcgatcctctatctaggcaggtgcgttttcttttgctaaaatgtgaaagaaagggtgaagaggatgacagaaaaacgttcactatatgagatgcaagaagaagtcgatgcctatatccaacaattcaaggcggggtatttcagccctttagcacagatggcccgacttactgaagaagtcggcgagttggcaagggaagtcaatcatcactatggggaaaaggccaagaagaagacggaagtcgagaaaacagttgctgaagaactaggtgatgtcctttttgtcaccatgatcatggcaaattccatgggtatcgatttgacggaagtttttgaatccaatatgaaaaagttcaaccgcagagatgcgtatcgctttgaaagaaaagatgggaaaatgaatgaagctgactaagttaccacaagaatttgaacaagcaatccctgtattgcaaagaatcgaagcagccgggtttgatgcctactttgtgggaggaagtgtcagagatacaatcttaggacagccaatccatgatgtagatattgcaacaagtgcctttccagctgagatcaaagaactttttcctcgtaccatcgatttgggtatcgagcacggaacagtccttgttttatgggaaaatgaacaatatgagatcacgacttttcggacagaagaagcctatcaagatttccgtcggccagacaaagttgcttttgtgcgctctttggctgaagatttgaagcgcagagattttacaatcaacgcttttgctctgaaaaaagatggtgaaatcattgatttgtttgatggactggcagacctgcaactgaaaattctgcgagcagtgggtcagccgcacgaacgatttcatgaagatgcactacgtatgatgcggggcttgcgctttgtcagtcaactgggctttacattggaaccacgaacatttgaggcaatttatgacaatcatcagctattggcaaaaatatccgtggagagaatcaccattgagttcgtcaaattgctgttaggggcacatcgcaattcagctttaaaggcttttgtagcgactgaatgttatctctattgtccaggactgaaacaagccggtgaagctctgttgcgaatggctgatttaccggagagaccattgaacaatgaagcttctgcctggacactattgattgaccagattggactttctacagcagaagttcgtccttttttgaagcaatggaagtgttccaatgaattgattcggatggtccaatcgttattcgagggagtattgttgcggaaagcagggccgtttagtgatgaagcattataccatctgggcagcgaggccgctcgactatcagaagaattgctatactattacggacaagaggtagatccctctgttagtcaagctcgctaccaggcgttgccaatccattcacttaaagacttggccatcaatgggcgcgacttgctgagccactttgaccaatccggcggtccttggatgaaagaagtgctagcagctgccgaaaaagcggtgattgagaaacgagtcgcaaatgaagagaaagcattattggcttttgccaaaacaatcgtattaaataacctataaataagcaggtgagaaaacaatgatcgaaaaagaatttttggttaccgaggaagatacagctcttgcagttggatcgggaggactgcctgtcttagcgacccctcgtttggctgccatggtagaagctgtctgttttgaagcattggaatcgcgtatagcgtctggtaagacaacagtaggaacacaatttacgatcgagcaccgggcggcttcaggaatcggtgcaaccgttcaggtatgctgtgaagagatctcgaatgaaaagacgtatgagtttacttttcgtgtctatgaaaacgatcaactgctagcgacaggtacgcatcatcgagcggcggtcgatatcgaaggttttttaaaaaaagtgagcgagaaagaaagttaatttgtgctccttagcagacaatgtgttaaaattgaaatgtattattaaaaaaaaggagcgttatgtcatggcaagagaaatgaaagcattgaaattttatttccgtaatggagaaacatggacgattgagcgccgttatattggagatttgtggatcaagcaaatcactactagttttggccgcatccacggaagcgaatttgttgagatccatccatgtgcaggattcaaaattgaaatcttccaagaaggggatcatgttgcaacacatgatatcaatttaggtggattggaattaggcatgttcgcccgcgctttgaaatacgaagatattgaacgaatggaaattctttaccgtaatggaacacccgatcttgtgtacttcccatacaaagacaaagatactgaaggattagataacgtttatcaatcaacaaaaatcagtgaaaaaacaaaaagcctttatattgtgattgatccaaaccaaacagtcgaagacgtttaccaagaacattttgaagaataaaaaaaagcagaactgagagcttctctctggttctgctttttcattacaatcactgataagtgcgaaaaaagtcggtatatttttttaataaaagatagtcttgactgacggcatctttaagtatgattttgtctccaagcaagcttttacgagcattttggatgatgcggtgttgaatatcatgatcgatcaagtaatcgatctcagtacgtttgatttccggagaagcactctcgcgatttttttcaagatactgcaaaagatcatattcaagatgtccggcatcattgattactcgtttgtattcgattttgtctaccttcacacgatcacgctcctttatatgataagttaccttatttccggagtaatgtaaaaaaaatctatatgaattagtaaatttttaaacacctgtttggtattgcatcaaaactactttacgcttagaagaaacagctagatgtgtcgcaagacttaaacagaaaatgaaaacaaaggagaaacagatgaaaaaagcaagagttatcgttgttagtggagtgactgcttcagggaaaaccacctttatccaaaaggtcgccaatctatgtcccggtacagcagttttatcttttgatgattatagtatcgatgcattgccttctgcaccatcctctgaggctctgttaaacgaaccctacgaagcaatcaatcaatttgatattcaaccattgataaatgacctaaaacaaatcattcaccactgtgcgctgatcttgatcgattttccgtttgggtatgtccatcagcaactcgcacctgctatcgacaaggccatttatttaagaacacctctggatattgtcttgggtagactaatcattagagactttcaacaacagccagagaaaattattaattgggtcacggggtatctagaggaagcgcgaccgctttttttgatgcacgaagaaattgtttctccacaagcagattatattcgagatgggacgattgattttcaagaccaaatgacttggttcaaagaagaagttctagcggaaaaaacgattttcgcagaatgattgttggaattgggaaaaatacttgtcacgtaaagaataaggtcatcttttgagagataaaaaaaggggatcttaattttccaggtaatcaaagggaaaattggggtaagcaaaactttctttgattctatactttcccttgctgtattattatttatacgcatatttagtctatagttaaaaaatagcattattaacaattaaaaacaagttacgattttgtcatctatctattttaaagtgaacatatgggtatagctcaaaaataaaaagccaactgcaatgcttgtttatcagcaagtgcagtcggcttaaaatgaattattttgtttcacggtgtaaagtaacttttctttcacgtgggcaatattttttcttttccaaacgatcaggattgttacgtttgtttttgtttgttaagtagttgcgttctttacaagaagtgcactctaatgtgatgtttacgcgcatgtttttccctcccatatattcaagaatcctctaagatttctctcagactaaaatataatagcatgtttggcaaaggaatgctagtagtttaatgaaatttgttaagtaattttacttgacgattttttgaatgaaatcaaccattttcatccaatttatttttcacgtcttcgatcatttttgtataagcaatcggtccgttatacagccagctggattcaggtccaaactcccaaagatttccttctttgaccgctttaagattttgccaaacttggtctttaaaaaagtcggctccttgatcgctgtttactagaatcaggtaatcagcatctaattcagctaatttctccaaagaaacggcagaccagtcagctgtcgctgttttgctgatcttagaaacaagtggcggtacagagaatcctagttcatgatagaggagctgaccgctggaacgatcgtcagcaaccataaaagcagaattgttggtgacccagagaacagccaccgacttcccattgattttacctgaaaattcttgcttagttgtttttactaagtcatcatagtctttttctactgtttttgcttgatcttctttatgaagaacttttgcgatatctgtcaaacggtctcgccaagagacattttcaccatttttgactacataagtaggggcaattttgctgtattgtgcatatttatccccttcaaccatcgtattgctgtcgatcagcaacaagtctggttcataacttaagacgtcctcatagggcaagtcgtagctgatccttggtacatcacttagtttctcttgcaaatagccttgatcactgttattaccaacagtccattgtgctactggtgtgacgttcaaggctactaagtaatcttctaaataactgccgatgattcgctttggatcatccgggattgttacttcatgtccagccgcatctttcagcgttgccgtctcagctgaggaagatgacttggtattattggaattagctgaacaagcactcaatgctgttaagctgactagggtacaagacagccaaaaaagtgtttttatggttcgttttttcattaggttcctccttataggataaatgagaatcattctcactttctttttgtcattatcacgaagaaaaagtgatttgtcaatccctggttttttgctttgaagcattgacggatagaaggaaaaccgtcataattgataatcattatcaatagaattttgagggaaagatatggcaaacttacgcacggtcgatttgactgtcggctatcaaaaacaaaaaattgtgcaaaagataacaatcgacatcccagaagggaagatcattggtttgattggacctaatggtagtggcaagtcgacttttctaaaagcattagcccgaatcctgctaccaatggaaggggaagtttatctaaatgaacagaatctacaaacgatcaaaacgaaggaagtcgcaagccagattgctttgttgtcacaagtcagtgattcttccatcggattaaccattcgagagatcgtttcttatggtcgttttccttatcaaaaagggctaggtcggttgaccgcaaaagattatcaagccattgaatgggcattagctgcgacagatttgaccgaactagcggatgctggtatccatacgctttcaggaggtcagaaacagcgggtttggatcgctatggctttggcacaagatacagagattgttatcttagatgaaccgacgacttttttagatccggcacatcaactagaagtgctgttattgttaaagcgaatcaatgaaaaatatgggaaaacgatcattatgtcgattcacgatctgaatcatgcatctcgattttctgattatatttttgccttaaaagaaggtcaattaatgacttgggggacaccagaagaagttttgacccattcatggctccaacaattgttcgctatcgaagctgttttaggtacgtttcccaatagttcgaaaccgttgcttttgacctatgaattaggagccaacacatgaaaaaatttacgattcttttgcttgttctaagcggattattggtcgctgtgttttttctggcattgacgcaaggggcagctgatattcccttaataactattaaagaggccttttacgcatttgatccagaaaatcaaacccatcaagtgcttagaaatatccgtttgccgcggatctgtgcttcgtttattgttggcagcagttttgctgtaactggtgccatcatgcaaggagtcaccaaaaattcgctagcagatagcggtttactaggaatcaatagtggggctgcagtcggattagccgttgcatttatcttgtttccctcactacaaccgaatcaggcagcgttgttttctttcttaggcgcttttctagctacttcttttttatttttgttgacgaagtattcaaggatcggtatgacgccgactggattgattctagcaggtgttgcattgagttcttttttttctgcgattagtcaagtattatctttacaatttgatttgaatcaagacttggccttttggtttattggcggtgcagcaaatgtaacgtggacacaattacaagtgatcacccctatttatctggtggcgctcttcatcatcctaggactcgggaaatctttgaatttgctggctatgggagatgagacggcaatctctttaggcaaacatcctgaacggattcgacttgtttctttagccgtagttgttctattagctgggatggctgtttcactggtgggaccggtcagctttattggattgatggtccctcatgtgattcgcggactgattggcaaaaattatcaaatgatcttacctttgacgatagtggcggggggaatattggtaatcttagcagattgggtaggacgaatcattcagccaccttttgaaacgccttttggaatcatgatggctttgattggggttcctttcttattagtgaagattcggagggaacagctatgaagaaaaaaatcggtttcctttttgttttggttcttctggcgttttgtggcagtatcatggtgggaaagacgttcttttcttttgatctctggctcgctctttggcagcaaactctaacagctagccagtcattgatattcttcgatttccgacttcctcgagcagtactggcactgattgctggaagtgcgtttggcttctcaggttttttgttacagggagtaaccagaaatgagttggcggatgcaagtattttaggaatcaataatggagctggcttatgtgtcatgctctacttaggcttttatgcccagggctcccagctgttaccactaattggtatgattggcggactattagctgcactgctagtctatgctatcgcttataaacagcggcagctgctttcaatggagcgaattttattatctggaattgctgttaatgctggacttgcttctgcgtcgttattattgactgttcaattgtcaaaagaacgatatagttttgttacggcatggctttcggggactatctggggaacttcgtggacgcaagtactaagtttgttgccttggttcttgattctaggattgttggcattcatgattacacctttgatcaatttactgggttttggagaagaacaggcgatcagtttaggtgttcccctaaatcttttgcgcaccggtttgttgttcgtagcgattggcctggccgcaagcagtgttggctatactggaaacttatcttttattggtttattggcgccccatatcgctaaacgattgattggcaaagaatctcgttgggcattgatagcagcgggaatgattggtgctattttggtgctagtcagcgacacagtcggccgtcttttacttcaaagtggcgaaattcctgctggtatcgtgattgcgatcattggtgctccgtactttttgtttttgctgattcgtcaaaaaacgtagtcgtgagaattttttcacgattgcgtttgctatttgagtccggtttttggtactattcggagtaggagttggttaattatggataaaaaaattttgcgtgaacaagggctaacccgactcaagcaactggatccacgaacaaagcaaaccaaagagcagatcattcagtctttgttgtttgcttccgaagagtggctcgaagcagaatccattggcgtgattcggtcattgccgtttgaatttgatacaaagccgatttttgagcgcggatttcactctggcaaacaaattgccgtgccacgttctgtgagaaagaaacttcacttttatcaagtggaaccacagactgaatatcagctttccagttttggggtagaagagcctctttctcaaaaaaaaatcgatgcattggacctggatcttttgatcgttcctggtttgattttttctcatgagggatatcggattgggtttggcggcggttattatgatcggtttctggcagatttccaagggaaaactgtgtcattggtttttgcagaacaatttgatgtccggtggcaacctgattcttttgatattccggtccagaaaataatcactgataaagtttctttcggagaaaaaggagtagacaatgaataaacaaatgaaacgctggcttaatcgtccaatctttacttatacgtttttagccatccagacgttagtctttattatcggctatattagtccgatgactcaagtgatgggggtgatgtttggcccttatgttgcttacatgaacgagtattggcgttttgtaacgccgattttcattcactttggtctcgctcattttgcagtgaattctgttattctttattttatgggtcaacaggtggaagcgatctacggtcatgctcgtttcttcattttgtatttgatgagtggggttatggggaacgcgatgagttttgcctttaatcaggccggtgtccaatctgcaggtgcgagcacgtcattgtttggtctgtttggtgcttttctgattctgggactccactttaagaatgattaccagatccaagcgatggttcgtcaatttgcattgttcgttgtcttgaatttcgtatttggtctatttgatcaatcgattgatatttggggacatgtcggaggaatcttaggaggattcatcttaggcaatgcattggctttaccaaagaacttcgaggaatattcgattcatacccgcattctttccgccattgtttttctttttttactggcagtttttgtgatatatggtttaaaaaagtatcaaatacttgtataataagcaggaagtgtgtttatggaaacgttatatgacgtacaacaactattgaaacaatttggtgtctatatttatgttggcaagcgaatctatgatatcgagttgatccagatggaagtcaaaaatctttatgacagccgtttgatcgatcgagatacctatttgaccgcttggcgcattttaaagcgtgaacatcggattgaagaaagccgggaggaaaataagtgatggacaaaaaaatcatcgggattgatctaggaggaacaacagtcaagtttgctgtgttgacttctgaaggagagattcaacaaaaatggagcatcgataccaatattcttgatgagggttcccacatcgtaccagagatcattgcatcaatcaatcatcgtctggatttgtatggcatgaaagcagaagacttcattgggatcggtatggggactccaggaagtgtcgatcgcaaaaaaggaacagttatcggtgcttacaatttgaattggaaaacgttgcaacctgtcaaagaagcgattgaaaaagggacagggattccttttgctatcgataacgatgccaatgttgctgcgttaggcgaacgctggaaaggcgcaggtgacaacaatcccgatgtgatctttatcaccctcggtacaggtgttggcggtggaatcatcatggaaggacaacttttgcatggtgtagcaggctgtgcaggagaaatcgggcatattactgtagatccagaaggatttgaatgtacttgtgggaagcgtggttgtttagagaccgtgtcaagtgcgacgggtgtcgttcgggtagcaagacatttggcggaagagtatgctggcgattctgaattgaaaaaaaatctggataatggcgaagatatttccagcaaagatatttttgaagcggcccaagcgaaagatccgtttgcattgatggtagtagataaagtctgcttctatttaggccttgcttgtggaaacttgggcaatacactgaatccttcaagtattgtactgggtggcggtgtctcagcagcaggtgaatttttacgtagtcgtgtagcagcttactttgcagaattcacattcccgcaagtaacggaaagcacggaaatcaaattagctgagttagggaatgatgctggtgtgatcggcgctgcgtcattagcattacaatttgcaaagtagagaggaataggtaagatgtctgtttggaactggattaatattattttaggattgattttattggcaatcgcattgaattgggcgtacttccaaattatgggaagacgatcagccaaaatcatttccgaagaagaatttaaaaatggcatgaaaaaagcacaagtgattgatgtgcgggagaaaaacgagttcgatgccggtcatatcttaggtgcacgaaatatcccatttacggtattaaccaattcgtttagcgcatttcggaaagatcagcccatctacttatatgatacccgtaaatctctaagtatccgtgctgcgaataaacttcgcaaagaagggtttaaagaaatttacattctaaaagaaggctatgaaggctggagcggaaaaacgaaaaagaaaactagttaatcaatcaaaagactgagatcaatgatcaaacaagatgttcctaagaggcgcgagaatgaatcgttagaaaccattcagcagctgtaactgagaatcttgtcatcatggactcggtcttttttttttgaaagaatgtgttaaggtagattcaaaggagtggaaggaaatgattaaagtaaaacgtgtatacgaggctgcagcacccacagatggttatcgggtccttgttgatcgaatctggccaagaggcgtcaaaaaagaagtggcggcgattgattcttggttgaaagaggttgcacctagtacggaattgcgtaaatggtttggtcatgatccagagcgctttgatgcgttttgtcaaagatacctagcagaactaaaaaagaagccagccgatgatgcctttagtgcattgcagcaaatagtaaaagaccataaaaccgtgacattggtttatggtgcaaaagatgaaacacataatcaagcggttgtattagctgaagaattgaaaaaactgccattgaagtaaaatcttcaatggcagtttttgtattaacgagagacacttttacgcatagctcgttttcttttttcttcatttagtgcttgttgttcgtcaattggatcgatcacttgttttttgacagtcatgactacgctagcagctgctgcgatagttgctactgtaccaactaagaaacctgaaagaaatcgtttcattcttctccacctcgcctttatctatttatttctattatgaaacaaaagtacaaaaatatcaaaaataagcccttgtatcgcgagtaaaggattgataaaatttagtaaatattttataataaatttactaaatgaaatgaaggagcgaaaaagatggaacagctacaacaaatttttgcagaaaaattcggtgaaaaaggcacaggatcgtattttgcaccaggacgaatcaacttgatcggggaacatacagattataatggcgggtatgtctttccagcctctatcacgataggaacgtatggtgtagcacgaaaacgggcagataagcaaatacgtctttattcggaaaacttccctgaaaaggggatcatcactttttccttagacgatttggagtaccgcaaagaagacgactggaccaattatcctaaaggtgtgattcgctatttgaaagcagcgggtcatgcaatcgactctggtattgaaatcgctttttatggcaatattcctaatggtgccggcttgtcttcttcagcctccattgaattattgacaggagtgattcttgatgatttgttcggattggcgatcgaacgtttagagttgattttgacagggaaaaaagttgagaatgaatttattggggttaattcaggtatcatggatcaatttgctataggaatgggaaaaaaagaccatgcattactgctagataccaacactttagcttatgaccttgtacctgcagaatttggggactatgtcgtagctatcatgaatacaaacaagcggcgggaattggcagattcaaaatacaacgagcgccgtggggagtgtgaagaagcattaaaacgacttcaaacgaaactgaaaatccaatcgcttggtgaattggacgaagcaacattctttgcacatacttcactgattgaagatccaaccttgatcaagcgcgcaaaacatgctgtaactgagaatcagcgtaccttaaaagctaaagcggcattagaagcgggagatttagaatcttttggtcatctgttagatgcttctcatgcttctttaagagatgattatgaagttacgggtatcgagttagacactttggtggcagcggcacaagaacagccagcagttttgggagcccgaatgacaggggctggatttggtggttgtgcaatcgctttggtgaaaaaaagcgagtgggaagcttttgcaacggctgtcaaagaaagctatcgtgaaaaaatcggctatgagacagatatttaccaagcaagcattgatgatggcgcgcgaaaactgtagaatgtaagacggattcattgaataaatgaaagaaaaggatgattaagaatggctattttagtattaggtggcgccggatatatcggctctcatgcagttgatcaattgattacgaaaggataccaagccgttgtcgtggataaccttttaacaggtcatcgtcaagcgatccatccagaggctgttttctacgaaggagatattcgagacaaagcatttttgcaaagcgtttttgagaaagaaacgattgatggcgtgatccattttgccgcaagctctcttgtcggtgaatcagttgagaaaccgttgaaatacttcaacaacaatgtgtatgggatgcaggtattattagaagtaatgaaagacaacaacgttgatcatattgtcttttcttctactgcagcgacttatggcgagccagaacaaagcccaatcacagaagaaacacctacaaatcccaaaaatccttatggggaaagcaaactcatgatggaaaaaatgatgcgttggtgtgatgaagcttacggcatgaaatacgtcgctttacgctactttaatgttgcaggagctaaatcagatgcttcaatcggggaagaccatgatcctgagactcatttagttccactcatcttgcaagtcgctttaggtcagcgtcaggagctagcaattttcggtgatgactatgatacgccagatggaacttgtatcagagactacgtacacgtagaagatctatgcaacgcccacattttagcattagaatatttgaaaaaaggcaatcctagcaatgttttcaatcttggcagcaacaatggctactcagtcaaagaaatgttggatgccgcgcgtactgttacgcaaaaagatattccagcgaaagtagcaccgcgacgtgccggagatccgggaacattggtcgcttctagtgataaagcaaaagcggtgttaggttgggaacctagttacaccgatgtgaaacaaataattgaaacagcttggaattggcacgttagccatccagaaggttatcaagactaggaggcaacaaaatgacgctcagtcaaacaatctgtgatttcgtgacattagcgatccaggctggtggttggatggaaatggatcgtatttatttacaaaataggatccttggtatgattggtgaagaagactttgaatcagctactgtacgaccggtcgaagaatcagccgtggtattgatggatcaattggtcactcaagcaaaaaaaaatcaggtgatcggcgaggcacttgctgataccgaaatccttgaagcgcaattgatggatttcttgacgccaccgccttctgtggtcaatgctttctttgcccagcactatgcaaaagacccacaagaggcaacggattatttttaccatttgtgtcagcaaaatgattacatcaagactcgagccatcaagaaaaatattgtttttccggtaatgaccgagtatggagaattagagatcacgatcaatctatccaaacccgaaaaagatccgaaagaaatcgctgcgcagcgagcagcagcagcgatcgattatcctaaatgtctcctttgtttggaaaatgaaggttataaagggcggctgaattacccggctcgaacaaatcatcgcattattcggatgaatctggacggcgaagcgtgggggcttcagtactctccgtatgcttattacaatgagcattccatctttttgtctttagagcatcgtccgatgaagatcacgcgcaaaacctttgatcgtctattgcaaatcattgaggttctgcctcactattttgtcggttcaaatgctgatttgccaatcgtaggtggatcgatcttgtcccacgatcattatcaaggtggacggcatacatttgcgatggcaaaagcacccattgagaaaacattcaaactaactggttttgacgagctaacggtgggaatcgttaaatggccgctttcggttattcggattcaaggtcgagacaagcaaaaagtggctgctgcttctgattatattttggcacaatggaaagagtactcagatccttccgtttcgatcaatgcttattcagaagatggcacaccgcaccacaccatcacaccaattgctcgaaaacagggcgaatactttgaaatggatcttgttcttcgggataacaatgtttctgacgaacatcctgatggtatttttcatcctcataaagatgttcagcatatcaaaaaagaaaacattgggttaatcgaggtgatgggattagcggtcttgcctccacgtttagcaacggagttagaagaagtgagggcctatcttcttgatcagccaaatcaaattgctgcttatcatattccgtgggcacaagagatgaaggaaacctacaccatcactgaggagaatgtaacagagattgtttatcaagaagttggtgggatttttgcaaaagttttggaatacgcaggagttttcaagcgagatgcatccggtcaggctgcattcatgcgttttatcaataaactttgaagttattgagatgactttgaaagaatggaggcgcgggaatggctacaattaaagatattgctgaacaggcaggcgtttcaccagcgactgtttctcgtgtcctcaattatgacagtgagttagccgtcagttcagaaaccaaagaaaaaatattcaaaaccgccgaagcactgaactatacaaagcataaaaagaaaagccaagtcgaaaacggtcggattcgtttgattcagtggtttgataccgaagaagaactggccgatctttactatttagctattcggcttgggattgagaacaagacggaagaattggggattcgcttgttaaaagaatcgtttgcttctatcagtgagacccaagtagatggaacgattgctttaggaaaatttgatgcccagcagatcgcacaattaaaaaagacgcagcctcatctgctactcgttgattttgacgggctgtcggctggagtggattcattggtagtcgattttcagcaagcagtggatttggtcattgatcattttgttgctaaaggacatcaaaaaatcggtatcttatctggtattgaatttacaaaaggaagtcgacaagaaattgaagatccgcggctgacgctattcaaggaacgactgacacgcttgcgtctttatgacgaagggtatcacattgcagcagcgtttactgtcgaagatggatatcaggcaatgaaacagttcttgcaagacgccttgccactgcctactgcgttatttgcttccagcgatgctttagccatcggagcactgcgggcactgcaggaagaaaagattcgtgtgccagaagatatctccttgatcggctttaacgatgtcagtgttgccaagtatgtttttccaaccctttcgacaatcaaagttcatacggagtggatgggagagttggctgtaaccacactacttgagatcatcaagaatccagctcctgttccgcgaaaggtcaccatcgcaacggagttgattaaacgtcaatctacgaatcaatgatggggaagttcatctgcaacaaatagaaatgtcctgagaatctatgggaaaaagtctccagtaatggaacagttttccgtcgcagtcagaaactgtcgcggctgccatagattctttggccatttttttagttcaccagtaaccatgcacctatgaaagcaaataagcaaagtttggcattttatcagaatatggtaaaatatgagtgagttttttgattggggagaaaaagcaatgaaaacattagcgatcgatacatcaaatcaaacattggccattgcagtcatggatggtcaggagatcctaggacaaagtcagacgatggctatcaaaaatcacagcagtgcattgatgccggcaatcgatttattgatgcaatctgtgggggtattgccgcagcagttagagcgaatcgcagttgcccaaggtccgggatcttatacaggattgcggatcggtgtcacgaccgctaaaacattagccgatacattacatatcccattggtgggcgtgtcgagtttgaagaacatagctgcgaattgtgttggggttttgaaagtgatcgtgccattatttgacgcacgtcgcaacaatgtctatgctggtggctatcgttggcaggaaggggagctgcagtcagtgatccctgaccagcatgtggcattaccgacattgttgcatgcactagctgagttgcacacagaggtactttttgttggcgctgatgctgcaaaatttgccccgcaaatcactgaagccatgccgtctgcacagatcaatcacgtttctttgtggaattatccgaatggcgtcgtgttggcagaattaagtgaaacagaggaacccgtttcgtcgatccatgattttgtgccagagtatttgaaacttgttgaagcggaagaaaagtggttggcatctcatactccaggagcggatacgtatgttgaaaaaatttaaatctttcaaaggaaagctgcccctttttcgtaaagttcaatacccagaacagacgaaaacgattcaggatgaaacgtatgtgattcgtgaaatcgtcggcgaagatatcaaagagttactgcaagtggaacgattggtgtatgccggcgagctgccttggaccaagagcgcgtttctttcagagatttattcgcgatttaagcatttgtacttgtgtatcttacaaaatgagcgcatgatcggttttgcgggcgttcgtttgttgggagaagatgctcatattaccaatattgctgttatacctgaatatcaaggccgaggtgtcggctcttttttgttgactgaaatcgaacagtatgcgcgaaaaaacaaatgtgaccgaatttcgttagaagtgcgtttaagtaatcgtgacgctcagcgactttatcgacagctgggctttgtctcgcgagcgatcaaaactgcctactatacagaaggaaatgaagatgcattggatatggtgaaatttttaaatgaataaactgttgaataaagaagaattgcctgcaaaaagtgaagagctgttatggcaattggcagaagcgagttaccaagatggctctccctggacttgtgaacaattcaagcaggatttggctgctgttgacagtcactatttagtactccagccaatggaggcatttgttagttaccgtcgggttttagatgaagctgaaatctttaatctcgcagtcttaccggaaaaaaaaggacagggattggggaaactcttgctgcaagctgttattcagtcttgtcaatctgctggcgtcgaaaggatttttctagaagtgcgggtccgtaattttccagcacaagccttatacctgcgaatgggttttgaaatcattgggcggcgcaaaaattattatagtcatcctcaagaggatgcattgatcatggaaaagaaagtgaggccagcatcaatcaaatgaatgaattgattttagccattgaaagcagctgcgacgaaacaagtgtcgctgtcataaagaacggggacacgattttaagcaatatcgtggcttctcaaattaaaagtcatcaacgttttggtggcgttgtcccagaagtagctagtcgacatcatgtggagcagattactctttgtttagaagaggcactgaaacaagcagaagtgacaccagaagacttatccgctgtagcggtcacgtacggtccaggcttagtgggggcgttgctgatcggtctttcggcagccaaagcgtttgcctgggcgcatggattacccttgttgccagtcaatcatatggcggggcatatctatgcggcccgttttgtcaaacctctgacctttccattgcttgccttgctagtgagcggtggacatacggagttagtttatatgacagaagatggttcctttgagattattggcgagacacgtgacgatgctgcaggagaagcatatgacaaggtaggacgagtcttaggactttcttatcctagcggaaaagaaatcgatcgtttggcgcatttaggtgaggacacgtaccattttcccagagcaatgattcatgaagacaattttgattttagttttagcggattaaagagtgcctttattaattttgtccataatgcgcagcaacgaggagaaacattggacgaagccaaccttgctgctagttttcaagcaagtgtcgtagaagttttggtcactaagacgattcgcgcctgcaagacttatcctgttaaccaattgattgttgcaggtggcgttgctgcaaaccaaggcctgcgtcaggcactagatgaagcaatgagtgacctgcctgagattgacttgattattccacctttgcgtttatgtggcgataatgcggcaatgatcggggcctttgggcatattttgttagaaaaaaaacagtttgccccactatctttgaatgctgtgccaagcctaagttttggtcatgaaatgaaataatcaagcatttgctgctcaacattacagagaagaccgtggcgtcatcgggatacgaatccgaatggcagcccacggtcttttgtttaattatttggataaaattgattaaaaatacgtaaaacttgtatatattgaataaaaattataaaagatgtatactggctaaaaaacataggcaagaaagggtgcaaaagaaatgaaatccgtttttaaaggtcgcagttttttagcagaaaaagattttaccagagatgaattgcagtatctgatcgatttttcattacatgtaaaagaattaaagcaaaagaatatcccgcatcgttatttggaaggaaaaaatgtcgctcttttgtttgaaaaaaattctactcggacacgagctgcctttaccgttgctgccgttgatctaggagcgcatccggaatttttaggagcaaacgatatccagatgggatcaaaagaatctgttgaggactctgcaaaagtatttggtcggatgtttgatgggatcgaatatcgaggatttagccaaagaatcgttgaagacttggcgaaatattctggtgtacctgtctggaatggattgtctgacatgtggcacccgacacagatgatcgcagactttatgacgattcaagaaaattttggcagtcttgaaggtctgacgatcgcttactgcggcgatggaagaaataacgttgcgcaatccttacttgtgactagcaggattctcggtgttgctattcgaatcatcgcaccaaaagaattacagccggaacagcaagtcatcgagctggcagagcaatttgcccaagcatcacaagccgaaattttgattacagatgatgtggcagctgtagcaggagcagacgttgtttataccgatgtatgggtttcaatgggagaagaagcaaaatttaaagaacgaatcgacttgctgatgccttaccaagtaaatgccgaattaatgaaaaaaaccaataatgaacaagccattttcctccattgtttaccagcttttcatgatacacaaaccaaatatggggccaaaatcgctgctgattttggcttgaaggagatggaagtgacgaatgacgtttttcacagcaagcaagcgcgccagttcgatcaagcagaaaatcgccttcactctatcaaagccattatggctgtcacccttggagatctatttattccaaaggtttaactagcgaaatccatgcaaaggcgaaaaaccggctagccaaaccgattattttttgttatactttctgggaacaaaatagtagataatcgatgagcaagaagagtagcttttgtttttcagcgagttcgggaaggtgtgagccgaacaatcaagaaagtgaagcgcacttgtgagattttgcctagcaaacggaattctgccgttatcagaaataagtaggtcttttaagaatcattccttaaaggacaaatagagtggtaccgcgggaaatctcgtctctagtgcatgtgatgcactagagactttttttagttgttccgcatgtacattcgctgggcattgctttcgtatcgaaacaaatggagggaaagaaaatgaataataaacaaatcgttgcacaagctatttatgccgctgtcaaagaagatttgactttagaacaagtcagtcaattgttagaaaatcctaaaactgctgaacacggagacgttgcttttcctgcctttgctttagccaaagtctatcgcaaagcaccgcaacagatcgctagcgagctggcggaaaaaattgatccagcttcttttgaaaaaatcgaagtcgtgggtccatacttgaacttttttatgaataaagaagtgatcagcgaacacgtcttacaaaccgtcttgaaggaaaaaaatcattatggagatcaatcaattggcaatcagcaggcggttccgattgatatgtcttcaccaaacattgcgaaaccaatctccatgggccatttgcgttcgacggtgatcggtaattcgattggctttattcttgaaaaaatcggttatcagccaattcggatcaatcatttaggagactggggaactcaatttgggaaattgatcgtcgcctataaaaaatggggttctgaagaagcagttaaaaaagaaccaatcaatgaactcttgcgtttatatgttgaattccatgaacaagcagaaaatgataaagcgttggaagatgaagctcgggcatggttcaagaagctagaagacggtgatcaagaagcaaccgaattatggcaatggttccgcgatgagtcattgcaagagttcaacaaaatctatgacatgctggaagtaagttttgattcattgaatggggaagccttctacaatgataaaatgacggaagtcgttgaacttttggaagaaaaacatttattacaagaagatcaaggcgcagaaatcgttgatttgactgcctatgatctcaatccagcgttgatccgcaaatctgacggcgcaacattatatatcactcgggatatggcggcagcattgtaccgcaaacggacttataactttgctaagtctctgtatgttgtcggtaacgaacaaagctatcattttaagcaattgaaagcagttcttaaagaaatgggcttcgattggtcagatgatatgcaccacatcccatttggtttgatcaccaaagatggtaagaagctgtctactcgtaaaggaaaaatcgttttattagaagaagtattgaatgaagccatcgaatctgcgaaagaacaaatcacagaaaaaaatccaggcttagcgaacaaagatgaagtggcaaaacaagtgggtgtcggtgcggtcgtctttcatgatttaaaaaatgatcgcctgaacaacttcgatttcacattggaagaagtcgttcgttttgaaggagaaaccggaccttatgtccaatattctcatgcacgggcgatgagcattttagaaaaagcacaatttgatcctgccaatgcgcaagctcttgctttgaatgatgcagagagctgggaagtgatcaagttgatccaacgctacccagaaactatcttacaggctgcagataaatatgagccatcagtgattgctaaacatgcgatcaaattagcgcaagccttcaataaatactatgcaaatgtcaagattttagcagaagatgcgcaaaaagatgctcgattggcattggtttacgctgtaacagtcttgttaaaagaagatttgcgtctgttaggattacatgcacctgataaaatgtaaataaaaaaaaagataccaacggcagcctatatgcttgccactggtatctttttttcgattctttagagaatagcatgggacttgatatattcagtcagcttgatggcatcttcatttgtacgggaaataacggctactgtatcaaagccggcgagagaacaaactttctcaggcatcgaaacttcatctaaagccgctgccaataaaggtgcattgtcagggatcgtattgattagcgtcataaattgaacacgatccactttggtgacgacatcttccagcatgtgaatcagccgttgttcttccgctttttcattttcttgagtattcattccttgaaagagaacaaattttgtttgtccagtctcatcaggctgtttgacaatttttagatcacggatatcgcgggagatcgttgcctgcgtagcggttactccttgtgcttcgagcaactgcaacagttcttcttgagttcccacactatgttctgcaataatctgtttgatcaataaatgccggtcggatttacgcataaatagactcctttaattgaattcttcagcattatcatagcagaaaaaggattaaaaacctaggctttagtcagactgaacacccgttgtttgtaagaaaaaaatgtaaaagtaaacagctaggtttatgaggaaaagcagttgcaattctttagtagctactgtatactgtttaaggcgtgagttttttgactccgcaaatccacatcttgttccatctgcgaagcggtgctgataatcagttcttcgaagagctaaagagcaagagaggaaatcaaaaaccaaattggaggaaacacatcatggcagtaatctcaatgaaacaattgctagaagccggcgtacactttggacaccaaacacgtcgctggaacccaaaaatgaagaaatatatcttcacagaaagaaacggtatctacatcatcgacttacaaaaaactgttaagttagtagatgcagcatacgactacatgaaaaacgttgctgaagaaggcggagttgctttgttcgtaggaacaaaaaaacaagctcaagaagcaatcaaagaagaagcaatccgttcaggtcaatactacgtaaaccatcgttggttaggtggaacattgacgaactgggaaactatccaaaaacgtgttgctcgcttgaaacaaatcaacaaaatggaagaagatggcacatttgatgtccttcctaaaaaagaagtcgttggtttgaacaaagaacgcgaacgtcttgaaaaattcttaggcggtatcgctgatatgccaagaattccagatgtaatgtacgttgttgacccacgcaaagaacgcattgcgatccaagaagcacgtaaattaaatatcccaatcgtagcgatggttgatacaaactgtgatccagatgagatcgacgtagttatcccatcaaacgacgatgcgattcgtgccgttaaattgatcactgctaaaatggcagatgcatttatcgaaggcaaccaaggcgaagaccaagtagttgaagaagatttttctgctgaatcaacagaaaatgctacttcaatcgaagaaatcgttgatgttgtcgaaggcgacaatgtatcagctgaataagaaatgatggagctgtttcaaaggctaggcgccaagcctcactctcctttgaaacagcttttttaaaaggcaagttcaggcttgttaaatgacatttaggaggaaaacaaaaaatggcagaagtaacagctaaattagtaaaagaattgcgcgacatgactggtgtaggtatgatggatgcaaaacgtgccttagttgaagtcgaaggagatatcgaaaaagccgttgatctattacgtgaaaaaggaatggctaaagctgcaaagaaaaatgatcggattgctgctgaaggattggcatctgttgctatcaacgggaatgctgctgcaatcgttgaagtaaactctgaaacagacttcgtttctaaaaacgaaatgttccaagatttagttaaagaaatcgcagaagtaatcgctgcaaacaaacctgctgacatggaagctgctttgcagttggaaacatcaaaaggtaaaatggaagcagcattgatcgaagcaactcaagttatcggtgaaaaaatcagcttccgtcgttttgaagttgttgaaaaagatgacaactctgctttcggtggctacttgcacatgggcggacgtatcgctgtcttgactgttcttgaaggaacaacagacgaatcagttgcaaaagatgtcgctatgcacgttgctgcaatcaatcctcgctatgtgaatgaatctcaaatctcacaagaagaattggatcacgaaaaacaagttttgactgaacaagcattgaacgaaggcaaaccagccaacatcgttgaaaaaatggttgaaggccgtttgaaaaaattcaaagcagaaatcgctttggttgaccaaccattcgttaaagatcctgacatgactgttgaaaaatttgttgcttcaaaaggcgcaacagtgaaatcatttgttcgttttgaagtcggcgaaggtatcgaaaaacgcgaagataactttgtagaagaagttatgagccaagtcaaaaaataattctgttcctcgaacagatgggaacgcatggaagtgcgctccctttttttaagcaaaaaccgattttcaaaaaaattgcacaaattcaaacagaatggcgccaatatgctacaatagtattggagaatgtacggaggaatcatcatgggtaaaccaaaatatcaacgtgttgtgttaaaattgagcggcgaagcattggcaggggatgaaggatttggtatcaaaccgccaacgatccaagaaatcgtcaaagagatcaaagaagtccatgaacttggtgttgaaatggcgatcgtagtaggcggtggtaacatttggcgtggtcagattggtgcacaaatgggcatggaacgagcgcaagcagactatatgggaatgttggcaacggtcatgaatgcattggcgttgcaagacactcttgagaacgctggcgtaccgactcgcgtccaaacatcgatcgaaatgcgccaaatcgcagaaccttatattcgccgtcgggcagaacgtcatctagaaaaagggcgtgtagtgatctttgctggcggcacagggaatccttatttctcaacagatactacggctgccttaagagcagctgaaatcaatgcagatgtgatcttgatggcaaaaaataacgtcgatggtgtctactcagcagatccaaaaatcgatcaaagtgcagtgaagtttgaagagcttacgcatctagaagtgatttcgaaaggattgcaagtcatggattccactgcaagctcattaagcatggataatgatattccgttagttgtctttaatttaaatgaacaaggaaatattcgccgtgcaatcttaggagaacatattggaacgacagtaagggggaaatagaatggctgacaaaattttaacagaagcaaaagataaaatgaaaaaagcagcagaaaacttgcagcgcgagttaggacaaattcgtgctggccgtgcgaacgcaagtattttagaccgtgtgatggtaacctactatggtgttccaacaccactaaatcaaatggcatcaatcacgattcctgaagcgcgtattttgatgattacgcctttcgacaaaacaatgatccaagaagtcgaaaaagcgatcatgcaaagcgacatcggtatcacacctgctaatgatggtacagtaatccgtttagtcattccgcaattgacggaagagcgccggaaagaattggcaaaagatgtgaaaaaagaagcggagaatgcgaaaattgctgtccgtaatatccgtcgtgatgcgatggatgcttacaagaagcaagaaaaatctggcgatatcacggtcgatgatttaagagaatcagaaaaagaagttcaaacattgacagacaacagtattaaagaaatcgatcagatcgcagctgaaaaagaacaagaattattagaagtataagaagcaggggcgcacaagcgccctttttttattcctaacaaagagaaaatgtttttgtttttctttaatatagatttctttttttacttttcataggcaagaaatatgattattgttataatgaaaaagatgaattttacgaaatggaagaggagcgaatcatatgttgcgtttttttccacaaaaagacaaatatgttaaggaagaaactgaatacgaacttgatccggcattacctgtgcctcagcatatcgcgatcattatggacggaaatggccgctgggctcagaatcggcgtttaccgcgggtggcagggcacaaagaagggatggagacagtgaagacgatcacgacccatgcctcgcggcttggagtcaaagtcttgacattgtacgcattctcaacggaaaattggaaacgaccaaatgaagaagtcgattacttgatgcaattgccagttgatttttttgacacgtttgtaccagagctgatcaaagaaaatgtgaaggtccatgtgatgggctttactgaatatttgcctgctcacactcaagatgctgtcaatcgtgccatcgaacagaccaaggagaatacaggaatggtcctgaatttcgctttgaactatggcagtcgtgctgaaatgctgcaggcgatccaaaagctgtatgaagaactagaccacacacaggagacggtggaaatcaccgaagaaatgatggaccagcatctcatgactggtttcttgcctgctgcacttcgcgatcctgaattggtgattcgaacgagtggtgaagaacggatcagtaattttcttctttggcaaattgcttatagcgagctctttttcactaaagcattatggcctgactttgatgcccaattgttagaagctgccatcggcagttttcaacagcgaaatcggcgctttggcgggttgaacaagaaggaggacaaaaagtgaaacaacgtgtgatcaccgcagtggtggcattagcattttttttaccagttatttatgtcggtggaatagccatcgagttgacggcagctttacttgccggaattggtgtgtttgaattatttcggatgaaaggactagcggttctcagttttgaaggggtgttatcgattcttggggctgtgatcttagtcttacctaaagatccttggtttgctttcttaccagcaaatacagataaaagtgctttgttttatctgattgtcttgttgttgctagggatcgctgtcgtttccaaaaatatgtacaccattgatgaagcaggtttccccgttttagtcagtctgtatgtgggtgtcggctttgaacgtttcttgacggctagattagtaccaaacggattagttgtgctgatttttggcttgtttattgtttgggcgacagatattggtgcttatatggttggccgccgattcggcgcacataagctatggccggagatctcaccgaacaagaccgttgaaggggcattgggcggaattgtttcggcagtcgttgtggcagctctttatttgttggcattcccaggcaacgattactttggccatggaagtctgatcatgatcgtattgacgattattttttcgattgctggtcagtttggtgaccttgtcgaatcagctatcaagcgacactacggagtaaaagattcaggcaatattttgcctggccacggcgggattcttgatcgttttgatagtatgctgtttgtttttccaatcatgtacttattaggtgttttctaaagcaatcatttagttagtctagataaacgagcaataatcacttgcttgactagataagtgctaggtcattaatttgtttgatcagctccgcagaaagaagacaatttttaacctcattttaaccttatttcaacctctaaatgaagcctgttttcacgggaccagacatttagaggttttttagttctcgactacttggcggtcgaagcttttttgacggacccctgtgaagaatgcgaggataaggaaaaaagaacactcttcctgttaaggaatgtgttgagagaaagagccacagtctttttatgcgtgttagagcttggttctttaaattcttgttacaataacgccggaagttcctcattaggtgtgggtgtgataaaataaagaaaggtttcccctttagcaagagggaacagtgaaagcgaggaaacagaatgaaaacgattcttgtgtttattatcatattttctgttgtggtcgtaatccacgaatttggacactacttctttgccaaacgtgcagggattttagttcgggaatttgccattggaatgggtccaaagctttttgcccatcaaggaaaagatggaacgacttacacgattcgaatgttaccattaggtggctatgttcaaatggcaggctggggcgaagatgagacagagctgacaccaggtatgccgatctcacttgtgcaagacaaggatggaaaagtcatcaagatcaatactagcaaaaaggtgcagttgcctcatgcgattccgatggaagtggtagactttgatctcgaagaaaagttgacgattgcagggtacatcaatggaaatgaacaagaaaaagtcgcttatgcggtcgatcatgatgcaactattattcatgaagacggtgtggaagtaaggattgcaccgaaagatgttcaatttcagtcagcgaaactttggcagcgaatgttgaccaattttgctggaccgatgaataacttcatcttagcttttgttttattcacagggttagtgtttgcacagggtggtgtacaagatgtgaatacgaccagcatctctggtatccaaaatggttcaccagccgctgaggcaggcttgaaagatggcgatgagatcttagcagtcaatggcaagacagtatccaactggcaggaattgagcagtgagatccaaaattatcctgacacgaagatcccccttgaagtgaagcggggaagtgatacattaacgattgaagcaacgccagaagggaaatatgctgaaggagaaaaagtaggatttatgggaatcagtcctggcttgaaaacaagtcttggtgacaagctattaggtggcttgaaattgaccttcaacaatgctttactgattttccgagctgtcggtaatttgatcgtacaaccagatctggacaaattaggcggtccggtggccattttccaattgtcctcacaagcagcctcacaaggggtagcttctgtcgtcatgatgatggcggcgatctccatcaacttaggaatcttcaatttgttgcctattccaggattggatggcggcaaactcgttttgaacattcttgaaggtgtccgaggtaaaccgatcagtcaagaaaaagaaggaatcatcacgttaattgggtttggttttttgatgttgctgatggtgttagtgacttggaatgatattcagcgctttttcttttgattagaggaagcagctgatatgggccaagcagggtgtatggtatagcaaagtgtttgcagcaaaggagaaaaaaatgaagcagtcgaaactgtttattccgacattgcgggaaataccaagtgatgcggaaacattgagtcatcaacttttagttagagccggttatattcggcaagtggcagcaggcatctacatgtatttgcctttagcccagcgggtgttggagaaaattaaaaaattgatgcgggaagaattagccaaaattgatgcagtagaaatgacgatgccagttttattgcccttggaactatggcaaagtactgggcgagacgggctttatgggcgctcactgtatcagttaacggatcgaaacgagcgggagtatgtcttggggccaacccatgaagagccttttacggaattgatcaaaagtgagatctcttcctacaaacgtctgccgatcagtttgtatcagattcagtcaaaataccgagacgaacaacgtccgcgcttcggtttgattcgcagtcgcgaattcatcatgcaagacggctactcatttcatgccgatgagtcaagtttagatacgacttatcgtcggtatgaagcagcctatcacgcgattttgcagcgttgtggtctggagtatcgcgcagtgattggtgataacggtctgatgggagggcatgattccaaagaattcatggcactgtcgcagattggtgaagaactaatttgctactcaacggaaagcgactacgtggcgaattggaaaatggccacaagtttgtatgtatcaaagaaatctcacgaaacctttcttgagcgcgcagagttgcaggttgatccatcttattctctggaagaagtagctgcagcttgtgagagtgacttgactaagatcgttcagtcctttcttttgtttgctgatggagaaccggtcatgattcttctacgtggcgatcatcaattgaacgaagcaaaagtcaaaaattttctagaagccgatcaattgaaaatagctacaccagaagaattacgttgtcatctgcaaactgaagcaatcagtcccattgcgctgccggaaaatgtccgcttatatgctgatcagcatgtacaagatttagcaaatgtgatcgtctttggaaatcaaccgggccattactatcaaaacgcaaatgtaggacgagatttttccccattggcatttgctgattttcgattggtgcaagaaggtgatccttctccagatggcaaaggggtcctaactttcacacgaggaatcgaagttggccacattttcaagctaggaaccaaatacagtgaaagacttggtgcgacagttgtcgatgagaacggtcaggagacgccagtcatgatggggtgttatggcatcggtgtatctcgtcttctatcaacaatcgttgaacagcacggcaatgaagagggaatcgattggccgaaagagattgcaccctatgatatccatattattcaaaccacaatggaagactcgtatcaaactgctttgtgcgaggaagtagagcaagcgatgcttgctgtcggttatgaagttttagtagatgatcgcaacgaacgtgctggtgtcaaatttgcggatgcggatttgataggctgtccgattcgattgaccattggcaacaaagcgacagaagggattgtcgaaataaaaatcaaacacacaaatgcaaccgttgaagttcgtaaagaggaagtggctacgacattaacgatcttgttgactgcatctgaatgatccgtgacaaaaatcgaggaagggggagccctttctcgattttttaatgaaagacaaaagaaaaagaggtatactaattaatactgagaaaaaggaggatggtcaattgtcaaaagaaagagagacctttgagattttattagagcaaatcaatgctggtcctaatttacgccaacatcctttgatacagaccgctcaaatcaaacaagtcgtggtccatcgccagtcaaaagcttggacattttacttgcagtttgatacattgctacccgttatggtgtatcaatcgttcaaacaacatttggaactggcctttaaggaaatcgctgcggtgcgaatgatcattgaagccaaggataatgccttcgatcaacaactgatccaagagtactggccattagcactcgcaaatcaaaactgtgatcgtccactagtacagcaagtcattaagaatcagctaccggtagtgaatgagaaaaaagtgatcctgcctgttaccaatgaagcggtaatcgcgattttgcagcaacaatatttaccaatcattgaagaaaactatcaaacatttggttttcaaaaatttcgtatcattcctgaaatggatgccgaacaagcagaagaagctttaaaagaattggaagctcgtaaagaagaacagactgctgctttccaattacaggctgctgagaacttgatcgcccatgaacagcggaaaaaagaagtgaaagctgttgaatttgacggtccgattgcattgggaaggaatattccagccgatgaacccgttaccccaatgattaatatcattgaggaagaacgccgtgtgacgatccaaggatatgtctttgataaagaagttcgggaattacgttcaaagcggaagatcttgattctgaaaatcacggattatacgtcatctttcagtgtcaaaaagttctccaataatgaaaaagatgaacaaatctttgaggcaatcgccaaaggcagctgggtaaaagttcgcggaagcgtgcaggaagatacctttatgcgagatcttgttatgaatgctcaagacttgattgaggtaaaacacgagattcggaaagactatgcacctgaaggagaaaaacgggtggaactccatcttcattcaaatatgagtacgatggatgccacgaataatatcagtgatttagttgcacaagctggaaaatggggacataaggcgatcgctattacggaccatggtggcgcgcaagctttcccagatgcccatcatgcgggtgaaaaagctggtgttaagattttatatggggttgaagccaatatcgttgatgatggcgttgcagtggcttataaccctaaaccagttcctttgacggatgccacgtatattgtgtttgacgtggaaacgacggggctatctgccgtttatgatacaattatcgaattagcggctgtccgcatgcataaaggcaatgtggaaggctcatttgatgaattcattgatccaggacacccattgtctcgcaccaccgtagagcttacagggatcacggatgaaatggttcgcggttctaaatcagaagaagaagtattgcgactctttagagagttttctgaaggagcaatcttggttgcccacaatgcttctttcgatatgggctttttaaatacgagttatcgaaaatatgggattccagaagccgaaaatccagttattgatacattagaactggcacgttacttatatcctgagttcaaacgttttggtctaggcgtcttatctaaaaaattcggcgtcagcttagaacagcatcaccgagcgatctatgatgcggaagccacgggccatttagcttggatctttgtcaaagaagcgatggaaaagcatggcatgctgctgcatgaagacttgaaccgccatgtgggaggagagaactccttcaaagcggcgcgaccattccatgcgacgatcttggcgaagacgcaagccggattaaaaaatttatttaaattgatctcgatgtcgaacgtgaaatatttccatgacaaagtcccaagaattcctcgctcggaattggtgaagctgcgggaaggattacttgtaggaaccgcctgtgacaagggagaagtctttgtcgccatgatgcaaaaaggggtggatgctgcccgtaaattagcagagttctacgattatattgaagtcatgcccaaagaagtttacgctcatttgattgagaccgaacttgttaagaatgaatcagacctagaagacattattcgcaacctgatcgagatcgggaacgaattaggcaaagtggtggtagctacagggaatgttcattatttgaatgaagaagatgcgatctatcgtaagattttgatcaattcaatggggggagccaatcctctgaatcgccatagtctcccagctgttcactttcggacgacagatgagatgctgaccgcttttcaatttttaggcccagatacagccaaagaaatcgtcgtgacaaaccccaacaaaattgcggatatgtgtgaaaaggtcattccagtcaaggatgatttgtatacgccaaaaatcccaggttccgagcaagaaatcacagatctaagttacaatcgtgccaaagaattatatggggatcctttgcctgagatcgttgaaaagcgattgaaaaaagaattagattccattatcggaaatggcttctccgtgatttacctgatctcccaaaaactggtacacaagagcaatgaagatggctacttggtgggctcgcggggatctgtcggttccagttttgtcgcaacgatgacggggatcactgaagtgaatccattagctcctcattattattgcccagactgtcagtactcggagttttatgaggacgggtcttatggttctggctatgatatgccagaaaaaaaatgtccgaaatgcggcacccgactaaacaaggacggtcatgacattccgtttgaaaccttcttaggtttccatggagataaagtccccgatatcgatttgaacttctctggggaataccagcccgaagcgcacaattatacaaaggttcttttcggagaagattatgtttaccgtgcaggaacgatcggtacggtagcagacaaaaccgcattcggttttgtaaaagggtttgagcgggatcacaatcttcattatcgtgcagcagaagtggaccgattggccaaaggggctaccggagtgaagcgcaccaccggacagcatccaggggggatcattgtaatccccgattatatggatgtctatgatttcacaccgattcaatacccagccgatgatatgaattctgaatggaagacgacacactttgatttccactcgatccatgacaatattttgaaactggatattttaggacatgatgatccgacagtgattcggatgttacaggacttatctggaattgatccaaaaacgatccctaccgatgatccagaagttatgcgtatttttggcggaacggatgttttaggtgtaacagaagagcaaatttattctaaaactggtaccttagggattcctgaatttgggacccgtttcgtacgggggatgttggaacagacccatccgtccaccttcgcagagttgttgcagatttcaggactttcccacggaacggatgtttggctaggaaatgccgaggaactgattcggcgcggtgatgccaacttggcagaagtcattggttgtcgggatgacatcatggtctatctgattcatgcaggattagatgacggtatggctttcaaaatcatggagacggttcgtaaaggacaatggaacaagatcccggatgatttgcgagatacgtatctgcaagcgatgcgggaaaataatgtccctgaatggtatatcgattcttgttctaagatcaagtatatgttccccaaagcccatgcggcagcctatgtattgatggcattgcgggtcgcttacttcaaagtatatttcccaattctgtattactgtgcctatttctctgttcgtgcggacgactttgatttgatcgccatgtcaaaaggcaaagaagcggtaaaagagcggatgcaagaaatcaatgacaaaggcatggatgcatcgacaaaagaaaaaaacttgctgactgttttggaattggccaatgaaatgttggaaagaggctatgaatttggcatgatcgatttatataaatcggatgctgagaattttgtgatcgatggcaacaagctgatcgcaccatttcgagctgtaccaagtttaggtctaaacgtagccaaacaaatctgtgaggcccggaaagatggtccgttcttgtccaaagaagatctggccaaccgaggaaaagtttccaaaacattaatcgaatatatgacagacaatggtgtcttgaaagatttaccggatgaaaatcaattgtcgttgtttgatatgctataaggaagaaatttattatcaactataaaaacgattcgcaggcactatctttctcagaaatgataggtcctcgaatcgtttttttgttttatacatcgacacttttgctgcatgtcataataaaaccatcaacaataatggaatgtaaatcatataaatcaaaacggagtagcctaatgaagaagcagcaaactcttcatctccatggtaatttctaaccaggatcggcacagaattttgaacaggcatcgatgcttggatgataaagacttgcaacatcaatgaaggaacctgtatccattgaccaatcagccacacgatcaatggagagaggagaaaacgacctgcgaggacaccggcaagatccttggtcatacgtaaattcttgataccactatagtaaacgatgatcccaatgatgaacatggatagaggcgtggtcaactcagaaagatagcctcctaggcctgcaataaatttcggtaaaggaaaatcgaagagcatccagatcaatccaataataaacccaatcaatgcaggagagaagatttttttcaacacaactaaagggtgaaaggagacttttgcttcttcgaaactagggctgtctcgagcgatttcatagatcccaaccgtccaaaacaaactagtgttgacaatataataaagcaagacataaggaacagccttttcgccaaaaatagccaggttgatcggtaatccaataaaaattgtattggaaaaagtaaacatggtggagaaggatccatgatgagtgggagctacttgaaagaaacgctgccaaagtttactgatcccataagtaatgacaatggataataatggaataatcattccagaaaacaatgaaaggaattcatcgcgggtaaaattcttgatgatattcaaaaacatacttgccggcagtgagagattcaaaacaagttttgaaaaggtatctgctgtacgatttgagaaccattgcttaaaagacaaccagtagccaataaacatcaaactaaaaatcacaaaaatattgctatatgcttggaacatgaactcacctctctttcactatagcgaatcttgattccataatcaattcaatcagaaaagaataccccaaaaaagcaatcaaaaaaactatgaccgagaagagtcggtcatagttctaaatttattttcgttgttgtttgccggcattacggccttttgcatttttatgattcaagttttttggcgttgtaggctgcgtctgctgcgtaggagtgacatctttccgaggcgtcacgaccgttttaggcggattggctttcatttctgcttcaacttgcgcacgaatcttaggtttcatgatgacatttgtaataaaggtttgcaggcagctgaagaccccgccgacaacccagtataacgttacaccagcaggtgcacttaatgacatgaagacaatcatcaatggcgaaacgatcaacattgttttcatcgtttttttctgttcttctgggattccaatggttgaaatatatccttgtatgagatacgaaataccagcaatggctacaaataggaaacttggttgtcctaaggaaatcccaaagaattccgaattttgaatcccttgtgtgtaacgagcagtaaaatacaaagctgaaaatattggcatctgaatcagcagcggcaagcaaccgattccgccaaacatgctgacattattttcagaataaattttttgcatgtctgcttgtgcttgcatttgttcttcacgagtggtcgcttttttcaagttggcttgtgcgatatctacctgcggtttcaagaactgcattttttcactttggatcatcgttttcttcgattgatggatcccaagcggtaagataatgaggcgtacaacgattgtcacagcgataattgcccaaccataagaccaatcgaagttttctaccagcatggtgatcaaattacctaatggtttcactaagaaacgatagatcatgccgttttcattcggtgttccatcagagtttgtgctgacgcatccggataaagtcagtaaaagtcctaacaatccagacgagagcagccatttattcatttttgacattcttttcttcctcttcactataaatttagacaaaaataactatactaaaaaagaccgactatttcaatgtacaaaaggaaattcattgaaaaatcaatctttcgtcgtagatttagtaaccatattcaacatcaaaacttgttctttccttgatagaaggatcttcttggatctttgtacttgtcactttaccagaaggagacggtgaatctttgaccgcttcaacaaaagcgtctacctgtttctcttcgccgatagcttcgatcgttactgaaccatcagattcatttttgacggatccttggatccccatccggtccgctaacaattttgtcgtgtaacgaaaaccgactccttggactctgccttgaacttgaatgcgtatttttttcatcaaatcatccctcgtttcagtcaacctctatagtatatgatagcgtttttctaacgaaagaacaagtttcatcctttgactcatgctataatgaggcgaggtgaacaggatgaaggaaattctttcaaaaaaaaatatattgatcaaagaggtcaaaaaactcgcacaaaaaaaataccgcaatcaaaccaatacgtatataatcgacggttggcatttggtacaagaagccattgcagcatcggcaccgatcaattatctatttgttactgataaaggaatccaagaaaccggcaatcagttaaaagactatcaagacaaagtatttcgtatctccgatgaagtagctgcttttctatcagatttaccgacaccccaagggatctttgcagtgatcgaaaaagagaccgttcaagaaacgattcatggaaattggctgattttagataatgtccaggatccagggaatgttgggactatgattcgtacagccgatgctgcgggttttgctggggtctttttaggaacaggcacagctgatcgttacagcacaaaagtcttgcgtagtatgcaaggcagcaactttcatttaccgatccttgaaggggatgtgccagcattcatccaaaaattaaaagcccaagggactgctatttacgggactgaattgaataaagaggcggtttcttatacggagttatctaagaaaggaacagctgcgtttatcttagggaacgaaggacaaggcgtccatccagatattttagggttgaccgatcaaaatgtctatattcctatctatgggcaagcagaatcactgaatgtagctattgctgccggtattttgatgtacttttttgtcagttagacttttttaaggaactgttaaactcaaagcaactctttggattctcctagaattctgtctgagcagatgctatacttctatttgtaagaaataagcagtatcaaaaaggtggcaggcataaatctatgacagaaaaatggcaagaagatagcgagtatatgtcttatgtagcagatttgttagagacagaagctgtaaaaaaattagccaattatgttcaacatatgagttccacacgtttagaacattcgatcagcgtttcttattacagttataaattggcaaaaaaatggggcggcaatgctcgtgcaacagctcgggctggattattgcatgaccttttctattatgattggcgtacaaccaaattcgatgaaggaacacatgcctatatgcatccgcgaattgccgttaaaaacgcagagaaaattactgaattaagtgatctcgagcgggacattattttgaaacatatgtggggagcaaccattgcaccaccccgatataaagaaagttatatcgtaaccatggtggataaatattgtgcggtgaaggaagcatcagaaccaatgactcaagccatgaaagcaaaatggcaacaacggttttggcataaacaacgaccaacacatctctaataaaacaggcaagcgcctagaatctgtagtgatttatcagattccaggcgctttttttgtatggtggtgaaacaattggatcgtggtgctcatgattccattcaaagggcatacttacgctagtttccaaagaaaaattcgagaatagtcatcaaaaagatgatgattgcaattccgcctatagctaacgcatgtctttttttgtgcatgaacaaaatggcgatatattctcgtaaaaaagcattcggcaagtaatagaaggctgtgtgtgagccaatcccatctgctttgacatgcgcttggtcggcgtacatccctgcccggaaaatatgatagttattggaagcaaagattgcgtgatatccttctggacgtaacgaatccatgatttctttggagaatttcatattttcgtaagtcgttgtcgaattggcttccactaagatttcactttcagggattccttgagaaacggcatattctttcatggccactgcttcaggaattttttcgtcgctgccttgaccaccggacatcaaaagacgaggggctgttttcttcgcacgaaattgaagatgataaaatgcgatagctttatcgatccgttgggctaataatggagaaactttctcgccattaaggagacctgcccctaaaactataatgaagtcctggtcatagcggggatgattgaattgataaataaccgagatcgacaaaaagttaagaaaaaccacaaaaaaataaagcagcgatgccggaaaaattgtaaataaaacactgacccaacttggtaaggcatgtaaaaaggaatccgataccaacaagatcgttaaaacgatagctaaaaccaatgtcaacaggttggccaatgagtgggattctcggcgtaaaacgacgattgaattccaatagaggaaaataatcaatccatacaaaccaaaaagaaaaacgaatagaaagccaactaatgcaacagctaaaatcccgccgactaaaatatcttctgtccgataaagattaacgagcaaataaatcccaaaggtcaagatgaagacattaaaaagcaaaccattcactaaacgatgcttgtttttaaaataggaatataaaaataatccggccaaactaagcggggctaagataaaaaaactgccagtacgtaattccgaaatggacaaataggccaataaagcggcaatcgtccaacaacactcgaagaaaaagatatctgggtcatcttttttcttgcggtaccaaaaaacaaaaatcgctcctaagatataagcgatactgaaaagcccaatttgtgtaaaatccattcttttcactcctttaaatctaagaacagtatacctaattttcgaagaaaaagcttgcagatgtggtcaaagttgctgaattttcttgaattcgctacaatggatagagaagaaagaaggaggcacaagcatggaattaggtgaagtgatccgagtaacactcccagcgttttatgttgtcggaaaagaagggaaaggtcttgctgaagaaggcccttcatgggtaccggcactatgggatcttgcaacgaaagattttgaagaaatcgagtttttgctagccgatcaagaagcggaaaatctgcagttctggggattgatgagtgacggagagaactggctggaaccatggcaagagacaggacgttaccttgcgggtgtccaagtcactacggataattttccaccagtagattgggtccgttggcaaatgccagagatggaatacatggtcgtaaaaacaaatgaagccaatctaaacatgatgacagagaagatgctgagagaagttcttccagaaaataatgttcaactggcagcagctattcaggaacactacctgcctaattttcaagaaggggaagtagaactgtattttcctattgaaccgattgcgcctgttgtaaccaaagaagagttactctcttaacaaaaaacttccagtgttttagtgattaccggtcttaccggcaacgccaaacactggaagtttatttttgattaaaagagatttgtaaagaaattggcaactgatcgccagccgataacaaaaatatttgctttttcaacggctttagtagtgatcagctcagtagtagggacttctttactaccatccatataacctaatgtatctgcaggaatcgttgctgttacttttcctaaatccgttcctttggcaactggtgcagagacagtttcttcgttcattgttttgttataatcgattgttgtagtgaagtcttttggatccatatctttacgtacccaaacagaaagatcattttttaccgctatgggaacagtaagttctttgccgtttttaacagcgaccgtttttgtatctgctaactgatcaccagcagatagaataggaacttgctcccacgcatcaaatgagtaatccatcagtttgcctgtttcggtgaaacgtacactaggattctcagcatgaccgttgacgtttaacactacggtgataatacgctggccatctcgcacagccgttccaacaaagcaagcacctgctaaatcagtggttccggttttcaaaccgtcaacaccatctttggcgttgatgaaaccaggtagcatccagttccagttgaccatctcaactggtgagtaggaaccttcaccaaatgttttggtaaccgtgctggtgacttctaatacttctgggaagtcttggagcaaatgtctcgctacgatagcgacatcttttgcagataattcattttcatcagtggaagtggaaccagggtaaaggttttctcccagataggtgttattcagtccggaagcattgacaatcttagcatctgtgattccccattcagtgagtttgtctttcatttgatcgacaaaggctggctccgacccggcaattttctctgctagggcaacgaccgcagcattagctgattgaatgtagctcgcttcataaaggtctttaacggtgtattgaacatcacgatgcaaaggaacattggacaagtcaggtgtgacactgaggtcggctgcatattgtgagatttcaacagggtcttcccaagtcaatttgccttgcttgacttgttctgctactagatacagactaatgatttttgtcactgaggcgatgcccatcggggtttctccctcttggtcatataaaattttgcctgtatcgaaatccactgaaaaagcagcttttgcatcgatagaaaagtttttgatttcttcagcggtaaatgtagtctcctcagcgtgggagatcattggtattccggcaataaaaaagagggttgctagacccgcaatcaatgaataccagattttggataatttctgcataggtaaactccttcgtttctgtatctaaatcaaaagtttaacaaagagtttcctgagttgcaatactctaacagaaagttcaaaaattcgtaagaaccagcttttttcttcttgccgaatcacaccagtgatcgctttgtcttgaaacaacagttgtttttagacataaaaaaagcttttctttaacgaacaaagaaaagcagtttttttatctaataaaactatcggcgaatatgatttcggggatcctcactttgcacttttacaggtactttcactgctcttgtttcttgctgcatcaattggcgggcaagaaacagcgttcctccaagtaatgcggctaaaccaaagattgaaaaaagtgaaacaaacgtcgctaacatagaaatcccttctttctgtttttaattaatgtggaaggtaggaatcgaacctacaccttaatctatgaacgatcatctatcactcaacggaacaccttgttcaaccacttcttattactatcatagcatgaactgtctaaaaatgctggtagaaagtctgagcattttcagaggaaatcaagaataaataatgaagaaactttgaagaaatcattcgatttttgtcaaaggatattgccaatcttctgcttcatcataaagggtgaagcgctggtccttttgttcaatgatcaaatggtaacccaatgaatctagtaaaaccaatcttgatggggtcagctcaacgatcacagtaggtgaatgtttcccatcaattgtcagtgaatgctcctctgtgatctcaatggatacagtgtctttcatttttgaagtgaactgccatttccccacgaattgttggcggggctcagttttttgcttttcttttcttaatatgagcgaactggcaacaccggtcaaaagtgacagaccaatcaacagtgaacgttttttcacattttcacatccattcctacctatgatggaactagtataccatggggaacaaagaaatcctcctactttggtcggaactttaaaagtttttaattgaccgtataatccatttatcaaaatcttacagccctcagaaaataccagaaaattgcagcggcagcggatagctgcagcaatgatgctgacccaaagcattgttccatagcttatggtaaaatcagatagaaagttttctgctttctcctactttaattgaaagagagtctttcactgagaatcagaacatcatcaattactagatcaactgatttagcgtttatttaaggaactccggctgttttaaggccgaggtattaatggagagggaaaaagatggaatatccaaatagtcacttagcgatatttattattcgggaaaatcgctttattgcccgctgtcgattgatgtcaggggaggaagtaatcgttcacgtcaaaaatactggtcgaggaaaagaggtacttgttgctggtgcgttagtcactttgcaatactggaatagtccaaagagaaaaactaattatgatttgatcgcagtaaaaaagggcgaccaatggatcaatatcgacagtcaagtcccaaaccgtttggcctatgaatccttattggacggaacgattcttttaccgcagatcacaggcaatctaactttactaaagagagaagtgacgtatcaccgttcaaagtttgatttttattttgaaacagatgtcggagaaaagggctttatagaaatcaaagggatgactttggaaaacaaacgagtgggtgcttttccagatgcgcccaccagtcgcggattgaaacatgtaagtgaactgatagatgccaagaaagaagggtactatgccgcggtattgtttgtcgtccaatttgaagacattgatgtcgcgacgatccatcgtgccatgcaaccagagctagcaaaaaaaatcggacaagcaattgcagacggaatccaagttttcgcgtataattgtcttgtggatgaaaccagcatttccattaataaagcagtaccttttgatcttatggctgcttttgaagacccaaacttataaggaaagagggaatatgaatgattcatttagggataatcggtacaaattggatcacggatcaatttgtacaagctgcacatgaaacgggacgctaccatctaacggctgtctattctagaaaactggcgactgctcagtcttttgcagagaaatacggagaagtgacttgtgtagatgatttaacggctttctttcaactagaagaattagatacggtatatattgcatctcccaacaatttgcattttgaacaagcaaaacaaggaattttgtcaggaaaaaatgtgatcgtcgaaaaacctgccttttcgacaccatcagaaatggctgagatcattgaattggccaatgaaaatcaagttttattttttgaagcagcgcgcaacattcatgagaaaagttttgacaccattgcgtctgtcttaactgaacatggcaatatcattggtgcaaactttacctatatgaaatactcttcacggtatgatgcagtgttagcaggagaggagccaaatattttttctccccatttttctggcggcgcattggtagatctgggtgtttatcccgtttatgcagcactagcttggtttggcagaccacaaaatgtttattattttgcccggaaaatcgtgacaggagtcgatgggatcggtacgatcattttacgttatgaaacttttgacgtaaccattcaaactggaaaaatcggcaactctgacttgaaatccgaaatatattttgaaaatggaacactggaactaaatgcagtcaatgccattgaacaagcggtattttatgaccgtacaaataatgaaacggtattaccggtgaccgcgcaggcaaatccgatggtcgaagaagctgcagattttgcagaagtcatcgaaaataaagcagatccccaattgggtgcgcgctatgaagaatggatcgaattagctcgtgatgtcaatgaagcgatctatctcatgagaaaacacgcagaaatctcctttgacgcagacaaagagtaaggaatggaatgtatgacagcaacttatttagcagaagtttggcaagaaaaatggcaaagcagcggcttttctgcgccatcactgattcaagaacgggtttaccccctcttgaaatcaggacaatcagtagtaggcgtttcgccgacaggttcagggaaaacattggcctatttactacctttattggaaactgtaaaagttggtgaaggcaatcagctcctgattttgacctcttcccaagaactggccatgcaggtcacacaggtcgcacgagattgggcccagcttttagatttgcaggttttaccactgattggcggcgcaaatactaagcgacaaattgaaaagttgaaggccaaaccagaagttttggtggggacaccaggacgagtattggaattgctcaaattaaaaaaagtcaaaacgcaacagattcacggggtagtcttggatgaagtggatcaattactgaaagaaggggcctttgggctcgctagcaaaatcttgacgcttattccaaaacaggcgactcgcagtttcttctctgcaactgccaatgaggttctaaaagaaattcaagaactggcttttgaaacaccacaggtcattgatgtgacagaggaagaccagagcaaaggggtgatccatcattattatttgaattacccgagtcgtaaactagtggatgctttgcgccggttggcttacttaccagattttcagggattgatttttttcaatgaattaagtgcattaggtaatgctgaagaaaaactgctctttcatggtttgccagtcgcctcccttgcttcagaccagaacaaactgacccgccgtgcttcgcttgatgggttccgtcagggaaagatttgtgaattactaacgacagatgttgctgccagaggattggatgtcgatcagctggggtatgtggtcaataccgaggttccacaagagaaagaatcttatcttcaccgagcaggtcgtgtgggacggatgggaaatgagggcacagtgatcacgatcgttcaagaccatacattaaaggatctaaagaaaattgccgcacagctggatctaacgctgcaagaagttttcttgcatggaggtgcgcttcacacagagcgtccggaagttaaaagtgaacctaaaaaagagcagagtgtgcagaaaaattccagaaaaacttctgaaaaattacacactatgccaaagaaaacgaagaaaaagcaaaaaaaccaaaaagataaaggcaaaagacgccattgagcgtctttttgtgttaccattaacggtggttaattactagtgtgtaatattgaggaggcattttcgtgaattcaaggaaagaagaaatctttcagacgatcgaactgcacaaacaaggtctgacagccttagaggttgcggagattttacaaatcgatcgcagtaatgcaagccgttatctcagtgaattatttaaagaaaataaaatcagcaagcgtgctggtcggccagtaatctatgaaccattgaatgaggaagttcatgtggatgtgtcctccgaggttagttttgaaagtctggtgggcgttcaagcttctttgaaagtcagtatccaacaggcgaaagcggccattctatatccgccccgtggactgcatactattatattcggcgaaaccgggaccgggaaatcattatttgcggagtgtatgtatcatttcgctgtggaatcaaaaatgctgaaaaaagatgccccatttgttgcgtttaattgtgcggactatgcgcaaaatccccaattgctatttggtcatatctttgggatccgcaaaggagcatacactggcgctgcggaagatagtcccggactaatggcgaaagccgatggcggtattttgtttctggatgagattcatcgtttgccgccggaaggccaggaaatgctctttacctttatcgacaagggagtctatcgtcctctaggtgaaagcaatcaagtgtacgaagcttctgtgcagatcatcggtgctacaacagaatcttcagaaacatttttgacgacattcaaccgaaggattccaatggccatcactttgccgaatgtggagagtcgttcactggatgaacgatatgaaatcatctccttatttatcaagcaagaagcaactcggctcaatcaacggatcgacgttgagcgagatgcgattttggcctttatgctgtatgaagcagaaggcaatatcggtcaaatcaaacgtgatttgaaattagtctgtgccaaagcatttctccattatcggacctacggcaaaaagcatttattgattcgtaaagaagattgttcactgcaagtccaaaaaggattgttgaaaatcaaagaaatgtcggaacgtctcgatcgatttttagaaggcaaaggcgattttttgagtttcgagcctggggatcaagatgttgtttggtcacaagatcctcaaagaaatatgcaggtttacaatgagattgaagagaaagtcagcagcttgatcgagacaggtgttgcaacgatcgatctggaaaatctgatttccaaggatgtggatgcctattttgaaatgtatgtagaagagctgacgcaaaatcccgttcacaaagagttgattccagaagatatttggaaactgaccaatcacctttatgatatcgctgagcaaaaattggatcgtacatacaatgaaaaagcacgttttgcctttgcacttcatcttcaaagtacattagaacgcgtaaaagaaggccacatgatcgttcatccagacttaaatacgattcggaaaaatctgaaatcagagtttcaggtggcgatggatctatcaactattattgaagaggaacgacacgtggagattcccttcgatgaaattggctttattagtatgtttctagctattcaggtgaaaaaacagatcatgccgcttgagaaggtagaagtcgtcgtcttgatgcatggaagagcaacagctagcagcatgctggaaaccgcacaggagctattggaaaccactagcggttatgcaatgaatatgtcattggatacagaagtgggcgccatgtatgaaaagttactggcctatgtttctaagaataaagataaattaagcaatggtctattgcttctcactgatatgggatcattgaactcttttgcaacacttatttatgaagaaacgggcattcggacgaaagcaatctccatgtccagtacgatgatcgtgctggaagctttgcgcatggcagagagtggacgcagtctcgaggatatctatcaaaacatccagcgttcctttgagacgatcgttcaagagcaattccgcacggttcgggaagccaaaggcaataaaaaggcagtaatcgttacgtgctttacgggagaaggtgtcgctgccaagctgtatcagcgcatctatccggtcgtcgatcaagagaaggtcgaaattattcaaatgcaatttattgagaaagaaaccttcaagaaacacatcgatgggttgctagaagaatatgagatcaaagccatcgctggcacagtagatatcgattatcaaaacattcctttcttttcggcttatgatgtctttgatgacgaacggttgaatgtgctgaagcgaatcgtttctgatgaagttcccatcgagaaaattgttcgctctcttgaaaatacccttacgcatgtcgggtctgtctaccatttgatcgagagcttgcaacgaatcgtccatcaggttcagaatcagctgcatgtgacactagaaccgactgtagatgccgggttagtaatccaccttgcttttcttgtggagagcaatttgaagaaggaaccttcccgagcatttaaggatttagcaagcttccaaaagcggtatcgaatcgagaccgatgtgttgcgaacgaacttgctgcaaatcgaaaaaaattatcaaatcaagatctctgaagatgagattgcgtatctcacacagatgttcttagaaaatgaaataaaaaatcatcatgaatccgcacacaatattagtgtgtaatgagaaaaagtaaaagtgtgtaagcgttaaattggtgcagaccattgttaaatcaaggtttgcactttttttattttggcacgctttttgctttatagtaaagtgtaaataataatttagaaaggagtgacaatgatggcgaaaaaaacgattatgctcgtatgttctgctggcatgagtactagtttgttggtaacaaaaatgcaaaaagcagctgaagcaaaaggaatggacgcagatatttttgcagtttccgcttcagaagcagaccaacatttagaatcaaaaccggtggatgttctattgttaggcccacaagtacgttttatgaaatcacagtttgaacaaaaattagcacctaaagggattcctttagaagtcatcaacatggctgattatggcatgatgaatggcgaaaaagttttagcacaagcagaaagcttaatgaagtagtgaagtaagaggaggatttttttgatggacgagcaaaatttggaagccattatgggtttgatcatgtatggcggaaatgcgaaaagtgatgcaatggaggcaattgcggcagccaaagaaggaaattttgaattggcagaccaaaagattgcggatgctgaagcatctttagtagaagcacaccactcacaaactggtttgttgacacaagaagcacaaggcaaccatatgacagtgaccttgttgacggttcattcgcaagaccatctaatgacatcaatcgcatttacagatctagcgaaagaaatcattgatatttatcgacgtatgagtaacgaataatctttgaacggatagaagtagttatttgttgattttatctcttagaaaaatcttctttggcgaatagaacttataggaggacataaaaatggatggattaacgagttggatggagaaatacattctccccgtagcagcgaagatcggtgctcaaaagcacttagtagcgttgcgtgatgcgtttattggaacaatgcccgcgacaatggctggttcgatcgctgtaatgatcaatgcgatcattcgcgatctgccgccacagttttggcctagttatgatgcaagtacaattccagttatacgtgaaattattagtattaatgggtttgtttggaatggtacactagctgtagctggattggtttttgctttttcttgggggtataacttagcccgagcataccgcgtcaatgaccttgccggtgggatcgtcggaatggcgacactgatccaaggaatcgctttttcatatagcacatctgttgcgacgacagttcctgcaaatttgatggatgaaatcaatgctggtacagcaacaactggttggtcagcaacagctgaaggaattacagctggcggctggggctggttgaatttgaaccatctaaatgggaatgcatactttactgtaatgatcatgggagcaatctcagtcatcattttctgtaaattaatgttagccaatattacaatcaaaatgccggattccgttccaccagcagtttcgaaagcttttgccgcaatcttaccggcaacgatcgctttgtatgttattgctattattaactttattgttggacaattgacggatggacaattgattatcgaccttgttcagaaatatattgctgaaccattcttgggtctttctcaaggaataggtgcagtcttgatcgttactgtttttgtgcaaatcttctggttctttggtatccatggtccaaacgtattggcaccagttttggaaggtatctggggacaagcacagttgatcaatattgatattttccaaaaaggatatgatggaaaaactggaacaagcgcggtattagcagccattgaagatggaaaagcgtatatgtgggttcgtggatcattcgatgcatttgcatggtttggtggttcaggtggaacgatcgttcttttgatcgccatcttagttttctctaaacgtgcagactatctgacagttgccaaattatcaattggacctggtatcttcaatatcaacgaaccagtcatgtttggtttgccaatcgtattgaatgcgatcatgttcattccattcattattgcaccgcttgttgctacaacaattggttggttagctacttactggggattagtctcaccagtttctcaacaagtaacttgggttgtgccgccaatgttattatcattcttagcaaccggtgcagactggcgtgcgccaatcgtcactttagtatgtatggtggtcaccttcttcatctgggcaccatttgttatctcagcaaataaaattgatccaaaattaggcgaatagccctttaatcgagaggaactgctatcgcttcatagttgaggtagcagttcttcttttcattcatttagaatacagttagaaaacagcagcaagaaaactgctcaaggaggaataaaaaatgatctcaatcgcaagtgctatgcaacaagatgcaatcaaagaattattagaaggatacaatgaagacggtgtgtcttacacatttaaagaaaaacaagggatcaaattgatttttactaccacagctgacgatgcagaagcagcagctaaaaaagcgaaagaattgattaaggcccaaccatggggatctgtgctatactttcaagcaaccgctgtttgatgtcgtaatacaactgatgtcagggacgattaaatagatagggatgaatcaaaatgataaaaaacggcttatttttgtgcagtatcgggttgcttgtgattttgtatagcatgaacccaagcaatatgcgtttagacattttcagttttactactggaattgctttgctgataggcggcggtttgttgtttatgaaaggcaagaaaaaagctgatcaatcaaatggaggacagtctaaatgaaaattgaaaaaacattgaacgttccaagtccagtctttttcgataaaataatcgactcagtgatatttgatatccgcaaggcaacaggcaaaacggtttcccgcaaacagttagccggatatgagtacgtcaaggaattttcagcttccagccgtgcaaaaatcaaaattgaagaagtcattgagaatcaagtctatcagtttcggacagagacaaccaaaaatgagtttgtcgttcgctatgagctggaaacgataaatgaaaagcagacaaaggtaatttatacggaaacgatgaagtcattcggtattttgcaacaaatgaatgatatgctgcttggaacgattctaggttattttaaacgaaaacaattcaaaaaaatgctggttatgatggaagaatcatattaaaggggtcctgtgacgccttttttgtgttttccaggtaggtaataggaggaaatcggatgagtgatgtacgtagaatggatgaagcaggcccacaagaagttttggatttagtggcttatgctttccaatgggaattaagtgtgaaaaataaggagcgttatcgcttactagcagagaattcatggaactatggttcgtatgatgatcaaggaaagttggctagtcaaatcatggccacaccttttgccattgattttcatggaacaagctatccgatggcaggaatcggttttgttgcgtcatatccagaatatcgaagtcagggaagaatcgaccgcatcatgcgccacatcttggaagattgttatgagcagggaattgtcctttcctatttagcacctttttcttttcccttttatcgtcgctatgggtatgaatacgtctttgaacgtatggtctatgacgttgctgctcatgaatgggccgatagtcccaaagtaacaggttcgattcagcgtctgccatggtcagaggctaaaagtgtgatccacgatatttatcatgcgatgccaagacataaaaaaggcggattgctgcgagcagattggtgggaaacgatcaaatttacgtatcgtaagccgtatacatttgccatttaccgcgatgaagctgggaataataccggttatttagtttatacgattcaagaaggcaaattcatcattgaagagtggggatacttaaatattgaggcttatcacggattgaatcgattgattgtctctcatgcccgttctgttgcccgaatcatttatcaaccaggttatgacaatgatattcgccaggcaattgctgccaaaccaatagcacactatcaggtgagaccggatatgatggcgcgggtagtcgatgttcatcgctttttggcgcaatatccttttacttatcagctaaatggagcttttgctattgagatccaagaagataaatatgcgccttggaacaatgggatttatgaaatctctatcaaggacggtcagcattcagtcgaaaaagtaacgcagacgcaacaaccaatagtaaaaacaaccgtgcagcgttttgtccagttatttatgggataccaaacagttgatacaatggttttcttggaacaattagtggtaaatgatgcagcaataaactgcatcaagtctaatcttccaataggaaaaccaatattagaagactatttctgatttatcgagtcgtccaaccagcaaaatacctgatggttccctcgcgttttaggtaggaatcctttaagaaatgagagcagtgatacggacagctgatggaccagatctgttttatcatctttggttttaacttgcttcttagacaagtgttctgttgcagctaagagttttttatctgataagcaaaaaactcttgtccaacaagagtttaacaggttctttcaacgttccctgccggaatcgaaccagcaactaatccttaggagggacttgttatatccatttaactaagggaacacaacaatcccattttacctgtaaattcatcttcctgcaaccctaagtcatagttatttttgttgcgggataagggaagatgaggaatagaaacccgatttatgcaatcgttttgctttatggataaaaataggcatggtacactttaggtgtaaccgatcaagtaggaggtaatgttgaatggtaaaatttgggaaagcttttttgtcgcaattaacaactgacggaatcaatggaccatttgtcacgatcatgctaaatactcacgtaggtcaccaaaatgtagagaaagatcaaatcaaattcaaaaattttgctaaagaagcaaaacgccgatttgagaagagatatcccgaccactcatggaacaaattccaggaaaaaattgagactctgcttgctgatcaggcattttggcgcagcagcaccaaaagtgtggcagtgatcttaacagcagaagaaacattgatccatcgcttgagtattcccgtggatgatcaatactatgtcggagatacaccttatctgttggcgatcatcaaaaatgcccaattcaattatgccttttatttacttgcattgaatcgggattccatgaaagtataccatgttgaaaacaagcaagtcactgaagtggcattgcctgaagacgctcctgttgacattgagactgctcttggtgaagaaatcagcggtggtggagatttcaattacagtgcacaaggtgcaccaaacagttctggtgaaggcgttgcctaccacggcttcagtgctaaagacgaagaggttgagatcgatcatgtcaattactaccaagctgtagacaattattttaaaaatgaatttccaaatgaggaaaatttaccgctttatctttttgcactccctgaaaatcaaacattatttaagaagattgcaaaaacaagtttcttcaaaaaagatgcttgtattgcgtcatcgcctgcttcattatccccacaacaaattgctgagtgtgcgcaaaaattgatggacgatctgatgcagaatgaagtagcttcttacaacaaactgcttgaccgcaaatttatggatcaattagtggacattgtaccagcagcgaaagaaggacggatcgcgcagctctttatcgccacttcaaatttagtggatggcttcggagaagacccggatactgagtatgatcgtcggcaagtgctgaatacattggccaaaaatgtgttggaaaacagtggagaagtctctatattggagcaaaaagatgcgccggatgagaaaagtttaactgcgatcttgcggtactagtttcctaaatatccgtaaagcaccagttgaataaattagcctgtgacataaacaacaagaagaataatctgaacgatttaccaggattgcttatcccttgtatagttgctactagaacttacaaactgtaggagcaatcgtagaatttttcggattagtccctttgttgtagaacatatgtcacaggctttttctctaaaaaagtgccttctttgtggggaagttaagaaataattgcgttttcattttttttaagtttgcgatagtcaagaagcaaaaactgtgctataatacgaagtgtagtttttgttacggtaatttatggtagcttgtttcattttaaaacatctcccacattttcaccatatacaagtaattgcaaaatatgtgttttaacacaaggaggatttttattatggaaacaggtacagtaaaatggtttaactcagacaaaggttttggtttcatcactgcagaaaacggaaacgacgtattcgttcacttttcagctatccaaggtgaaggcttcaaaactttagaagaaggtcaagctgttactttcgatatcgaagacggacaacgtggaccacaagctactaacgtaaacaaagcttaattattgcctatcagagcagcctagctgctctttttttgtgctttcattcaaaagaaggtagagtctaaatttgtttgcattttctgtatttgttatacttgaaaaaagggggactcaggatgggactgaatgaatttattttgggactggcgaatttggaaaagattcaacgggcgccggggttctttaagtttacagaacatagcgtcgcggcgcattcttttcgagtcgcaatgattgcccagacattggctgatattgaagagcaggcgggaaatacgatcgattggcagattctctatgaaaaagcattaaatcatgattatactgaacgattcattggagacatcaaaacgcctgtcaaatatgcaaataaagaattgcggcaaatgctttcgacagtagaagaaaagatgacagatacattcatcgaagaagagattccagaatcatttcagccgatttatcgtcgtagattagcggatggtaaagatgattccctggaaggccaattgttggcgatcgcagataaaattgatttgctttatgaatcttttgaagaaatttcaaaaagcaatccagataaagtctacaaagaaatgtttcgcgaagcagtaatgacggtcaaaaattttaatcaccgtcctagtgtgtcttacttctttgaagcggtctttccagaactattgaatgcagatttctatggaaaagaaaattttctagaagaaatcgcaaacctaatcaaaaattgaaatggtctgtgaaacaagtttacctatggaaaaaacatactaagagcagaggagaaactcatccgtcgataagttcctcctctgctcttagtatgttgtatgtttttgaagccttgtttcacaggctttttttattacaacaatgattctgctccatcaacatagacttctgtacccgaaatgtttcctgcatcttcagaggaaagaaacagcacgaggttagctacttgttctggaataccagtctcctgacgcaaaggacgttcccgttccggaaagacgattgggattttgattttttcaacagcctcttcgatagccgtattctcatcaatatttgttgaaatcgctcctggacaaatcgcattgactcggatgttgtagccggaaagctcgagtgccgccattttcatgaaagcaacttgaccagccttagatgtgctgtaggcactagcgccgaaatttttgaaaattcggttgccgttaaccgaacttgtgatcacgatactgccgccgttgatttttaaaaaaggaattgctgctttaactgtgacaaaagtactgcgaagattcgttgtaatggtcgtatcccaatcatctagtgaaagctcttcgataggggtccaggttccattgatccctgcattaacgtggagaatatcgacaccacccaactcttgtgccaacgctgtgactgcctgtaagagctcttctccttttgatacatcaaccacacgataaatcgattgaccttcagtagcttctacaaatgccttcaattctgtttcatcaatgtctaatagaccaacgactgctccttgatccagaaattgctgggcaactgctttgccaatgccggatgctgcacccgtcacgataacccttttattttcaaaccgtttcatttaaacgcctccttcttaattaaattataaaaaagttcctgacctttgtcgaaagatacggatggtccattgatttttgataggatgaacgtatgaggactttagtcctaaaatcaagcttctcgtctgattgatctcaaaatttgatttcctcgttattggctaaaacagatgtaagaggcaaagattttgtagtataatgcaagaagtgcgtaaggaggaagcgaaatgaaacccatatacgctgtggtcgaccttgaaacaacggggactgatcctgccattgatcgaatcatccaatttggctgtgttttgatccaagatggtcaggtcattaatcgatttgcgacagatatcaatccggatcgaagaatatcaaagcagatccagaatttgactcatatcaccaatcaacaagtgaaacgagcaccgtatttcgaagatgttgctcatacgatttataatttgttaacacaaacagtctttgtggctcataatatttattttgactatcatttcttaagtcaagaattaatccgatgcgggatgccgccccttgagattccaggaatcgataccgtggaattggcgcaagtttttttgccgacagaaagcagctttcgtttgggagatctggctgaaagtatcggatttgttcatgagaatccacatcaggcggatagcgatgcggaagtgaccgcggcattattgctgtacatcgaatcgatcatgcgtgaactgccatgggtgactttaaagcaaatcgcccagttgagcggtcaaatggggatgcagaccagtcagtatattcagcggatcgtcagtgaacgtaccgaagagccgcttcctgaacatttggaagaaatcgatggattggttctgcgaaaaaagagtgtgccattgtttgaatcaagctattttcaaggagagtatcctaaagttaaagcggataagatcaaatgttttgatggtcgcctcagttatcgaaaacaacaagcgcggttgatgaatgctgtttatgatcacttttctcatgaagaaaaaaatctgatcattgaggcagaaaccggcatgggaaaaaccatcgggtacttatttcctgcaagctacttagctactccaaaaaacccattaatcgtcagtaccacgtcgattttgctacagaatcagatattggctaaagacatcccattagtcaatcaagtactggaacaaccgttgcaggcaactgttgtgaaaagccatcaacactacattgatctccagcggttcaaagcaacattagaacaaccgcttgaacaaaaacagtatgcccagtaccagatgggacttttagtttggctgaccaaaactgagaccggagattttgatgaattgaatcttgtgcgtcttgatcatccgttgtttttggaaatccgtcatcgaggggtggattttttggcaaagaatcaatctttttatgagcaggattttgtgcgccatctctataataagatgacacaaagcaatgtgctgattgtcaaccatgcatttttgatgcaggaaaatcggcgacagtatccactactaccaacgagtgactttctgctgatcgatgaagtccagcatttgccggagattgccgaaagatattcgcaaaattcctttgattcccaacagttcaaacgacaatttttgcaaatgaatgaagaaggtttgtttgaagagatcaagcaactcgtcgctgaagaattcgatctttcccatttattttcattgtatatcgatgccatcaaattgattatcgatacgctagaagcctattttgaaacactcgtgatcgatggggaagaactgacacttgtccaacgcaaggatctttacgatggcagcttgcagcaagatcgtctccatcaaaaaattcatttgtattataaagaaattttagaaatccaacagcgattgcagacaaccttcatggcgacagaagaacggcgattggctcgggagcgcatcctgattgcccgcttgttcgattatttccatgatatggaggtacaggcagcgacggttcaatcgtggctgatgaattggcaacctcggtatgtccattggatcaagaaaaaagcagggactgctgcagcgatgattgaagtggcagacctgaagggaaatcaaattatcgaaagcaaatggtattcaaggtacaaacatattctttatttaggcggtacattgaaaattcctggtaacaaatcttactttgctcaccgattaggcattcctgaagtgacggtcaaaacgattccggcattttatgattatgaaaagcaagcacgcctgtttattgtcaaacaaggaatctcaattcagcaagcaacgaatgaagaatacgcgcaatatttggccgatgcattaacaccgttgctatttgaaaatttgcagccaacacttgtattattcactgctcatgaaacattgaaacgggtctatgaaaaactgcataaaaaagccttggaacaaggacgagaacttgtagcacaagggactggcggtagtcgcgagaaaatcatcaagcgctttttactggcggaaaatgggattctttttggaacagatagtttttgggaaggcatcgatttacccggtcaagcgctcaaaatcgcggttgtgacgcgcttaccatttgagaaccctaaacgaccgcttgttcaagcacgtcatgcttttttagcatcggaaggcattgatcctttcaaggaggatgcattgccaaaagcaattatccgaatgcgtcaggcgttgggacgtctgattcggtcggaaaatgatcaaggagtaatggtggttcttgatcgtcggattctttctacgaagtatggcaagcgaatacttaaaggtttgccaaaaaatctgccggtcaaagaagctacaccacaagaaatgaccgaggacatacgggcgttttttgattctggagcagaagaaacaccaaaaaaacatttttcttaaaagatagctgaaatctgctataatagagcatattatttttatggaggataacgagtgaaaacgaaagacaaagaacaacgccgtgtgatgattttactgggtgcgatcgtttttttattgatcgttatcatattctcatcaattttctacatccgttcgactcgtccgatgcgacaggcacgcaatgaagcaatcgaaattgctcaaaagtatacggatttgaaagaggtcgatcaattttattggtttaatcgtcaagcctcttcttttagtttagttggtacagatgataaagaaaataaaatcgtcgtcattattcctaaaagcggtgaaaaagtgtcagtttttaaacaatcagatggtctaacggaagaagccgctcgtcaattggttgccgaaaagcatccagaagaaacgatccagaaagctactttaggattgtttaaagagcaagctgcttgggaaatcatgacgaaagatgcttctggtgaacttcattattatttgctaggttttaaagacggcaaggaaatcaatgccatcaataatatttgatttagagaaaggatggttgacatgacactctccaaacgagcgtatcaagtagagccctcagttacattagctgcagctgccaaggctaaggcgttaaaagcgcaaggcgttgacgtattgagtttgacggtaggagaacccgactttattactcctgagaatattcgtcaagccgctatccaagccattgaaaatgggaaggcaagtttttataccccgacagctgggatccctgagctaaaagaagccatcctacgctatctgcaggagttttatggcgtaacgtatgacaccaaccaagtgatcgtaacagatggcgctaaatttgcgctttatgcgttgtttcaagcagtgatcgatccagcagatgaggtgattattcctgtgccatattgggtcagctatgcagagcaagtgaaactagcaggagggcaaccagtcttcgtctatgctgcggaaaccgagcaatttaaagtaacggtttctcaactagaagctgttagaacagccaagactaaagccattattttgaattcgccttccaatccaacgggagcaatttattcgaaagaagaactacaggctattggagagtgggcagttgtacatcatatcttgattgtttctgatgatatctatggtcgtctgatttacaatgggcactcctttacgccgattgctagcttgtctgaggctattcgtaagcaaacgatcatcattaatggtgtctcaaaaacatatgccatgactggttggcggattggatttgcagttggcgatcagacaatcattcaagcgatgacggatattgcttctcaagcaactagcaatcctacagctgtcagtcaatatgctgctgttgaagcactgtcagggaatcaagactccattgaaatcatgcgtcagcaattcgaagaccgattaaataaaatctatccgattgttgcagccattccaggttttcaattagtaaaaccgcaaggcgctttttaccttttcccaaacgtcagggaagcaatgaatatgtgcggatatgaagacatcaataattttgtggaagcaattctggaagagaccggagtagcagtcgttactggtgctgggtttggtgcaccagacaatttacggatcagctatgcaaccgattgggcaaccttggaagaagccgcaaaacgtttgcaggattttgttgaaaagaaaagccgaaaagcttaaaatgctttatggaacccttattatcagattggagagaaacgtgtggaatctattcaaattttagatgcaaaaaaacatgttggcgaaacagtacagattggtgcttgggtcgcaaacaaacgatcaagtggaaaaattgcctttctgcaattacgtgacggtaccgcatattttcaaggtatcgtggtaaaaaccgaagtgggcgaagaagtctttcagcttgccaaaaatttaaatcaagaaacggcagttctagtaactggtgagattcgtgaagatagccgttcgaaatttggctacgaaatcggcatcagcggcattgaagtagtgggcgaaagccatgaatacccaatcacaccgaaagagcacggcaccgacttcttgatggatcatcgccatttatggctacgttcttcaaaacaacatgccatcatgcagatccgtaacgaagtgattcgtgctacctatgaatttttcaataataatggctttatcaaaattgatccaccaattttgacagggtctgcaccggaaggaacaacggatctttttgaaaccaactattttgatcaaaaagcatatctatctcaatctggtcaattatatatggaagctgcagcgatggcatttggtaaagtcttttcattcggaccgactttccgtgcagaaaagtctaaaacgcgtcgtcatctaatcgaattctggatgatcgagccagaaatggctttcatgcatcaagaagaaagcttggaagtacaagaacaatacgttgctttccttgtacaaagcgttttggacaactgtgattatgcattagatgttttaggcagagatcgtgccattcttgaaaagtatacgaaattaccattccctcgtatttcttatgatgatgccgtagaactattgaaaaaaaatggctttgaggacattcaatggggagacgattttggttcgccacacgaaacatttattgcaaactcatttgatcaaccagtctttattcttaactatccaaaagccatcaaacctttctatatgaaaccacatccaacaagagatgatgtcgtgatctgtgcagatatgattgcaccagaaggctatggggagatcatcggtggctcagaacgggctacagattatgaattcttgctagaacaaatccgtaaccacggattagatgaaaatgaatactcttggtatttagatcttcgcaagtatggctcagttccacataccggttttggtctaggtcttgaacggaccgttacatggctatcaggtatcgaacacgtgcgtgaagccattccattcccacgcttattgaatcgtatttatccataggggatattaaaagccagcttctgggtaggaagctggctttttttggtaaaaggaagcaaggaatcttaggggaatgaaggtgcgagtttttggatttatcaaaagatcaccatatgccggaaggtgtaacttttattgaaatataacggttttgttacatttattttctttttgcttattatcaggtaaaataagaactaatgtaaataaatagaggttatttatgattaaacaaattgcaatttcgttttcaaaaatcgtttacttgtccttagttaaacttttttcactaaggagacgtcctaaaaacaataaaatcgtctttttgttaagttttccatccacaagtacctatgttttggatgctttagttgaaagatacggtaatcgtttggttatttgttataccagcaatgcgcaagaaacgattaaacgatttaatcaagaaagaatcgactgctatcctctgcagtcattttatatcttgtgtactagaatcatcccgattattaaagcgtcgcaaatgattatatgtgataattatttcgcctttctaggggggatgtcttttgatgaacaaacaaaagttgttcaaatatggcatgcaaatggggcaatcaaaaaatttggtttgcaagcccaatatgctaagaaagcaactgctaaggatcaacaacgttatcaaaaagtatatgatacgtttacgcattttgtagtaagttctccgacaatggctgaaatttttgctgaaagttacaatatcgatcctatctttttaaaattcggttatcccatgacggattattatttcaatcggaacgaaaaaaacattcttaaagaaaagaatattttatcaaaagggactaataaaaaaattgctctctatgttccaacctatagagaaaacgactatgagcttccgctggacttcgagcaaattgaagaacaaattggtgatgaatgggtattctatatccatgcccatccccatgataaaaaattaaaaagcttggctaagaaatatccatcttattttattgatgaaatgcaacatgacctaaaaaatttacttattgttgcagattgtctgatcacggattattcctcagttccatttgaattttctttagcgaatccaaatggaaaaataatttatttttgttatgactatgaattatatgatgatcttgtggggatacaagaggccttcaaagatactctggattcttcaatcgtgaaaacgccagctggattatttgaagaaataatgtcctccgaaaaacaggacttcgtggattttaatgcgaagtggaatacgtttgtttctggaaatgcaatgaactatttatttgaatggattgatgaacaatatgaaaactgaagagataatgggaatttttgtggatcaaattacctatgaggatgtaatcaatgatttaccaaattatatcaatagtagtcgtaaaatgactattgtaagtgtaaacccgcaaatcatcactgaaagcaataaatttcctgaaatcgtgcgatttatcaatcatagtacacatcgcatacctgacgggattggcgtagtcttagtttcgaaattaactggtggaaaaatcaaagaaagagtcactggttacgatttaatgttgaaattattggattacgcaaatactcataagaaaagtgcttttttttatggagcaaagccagaagtcctttctgatgcagttaagaacatcaatcagcgatacccagacctgattgttgcaggcgcagtggacggatatactaagatggacgatggaatcttagttgatcaaataaatgctgctcaacctgattttctttttgtagcgttggggtttcctcggcaagagaaatggttggctaaaaatacaaatgcgcttgaggcatcagtttttcaagatgttggggggagttttgatgttttaagcggtcacgtaaaaagagctcctgctttttttattaattgtcatttagaatggttgtaccgttctttgagcaatccaaagaggattggaagaattctacagttgccagtatttatggcgaaaagtatttattggaagatggtgcatagaaatgataaaacaaattattagttttatttatcgaacgttattcaatatagtcacagcaatctttccagtaaataaaaaaatagttttatttgaaagttttaacgggaatatcccttcagataatcctttagcgatttataatgctatggttcaagacgaagagtttgcaaactggaatctttattggggaataaaaaaagcaaatctattagaagcaaaagctatgtatccagaaatgaattttctttctcgctattcaatgaaatggttatgggtagcttcaagggcgggtttttggatttttaatgcacgaatgtcaaactggtttaaaaaaaataagcaaacagtctattttcaaacatggcatgggacccctttgaaaaaattaggattagatatcaaaaatgttgtcatgcctggtacaaatactaaatcctatcaagatagctttatcaaagaaagtaagcgttgggattatttagtagcacctaatgaatactcaaaagagatatttaaacatgcatttgctttcgaaaataattttttagatatcggatatcctaggaacgatcgtttagtgcaagcaaataatgagtttatagtcaaccaactgaaaaaagaactcctaggagaaaaacgaggcaacgtttttctatatgcaccaacttggcgagatgattattttatttccaaagggaattacaagtttaacatgcctttcaaattagaaaaaatgatacaacttcttgataaagaagatttgctaattatcagaccgcattatttagtaaaagattcaatagatatagatgggtatgaaaatcaagttagggtctgtgttgatgaggatataaatgatttgtttctgattgctgattgcttaataacagattattcatcagttatgtttgactttgcgatattaaagaaaccaatgatattttatgcttatgatttggttcattatgagaatgaggttcgtggattttattttgattatgatagtttacctggaccaatttgtaaagatgaaacatcattctataatgcgataaaaaacttttatacagaaaccagtaaaaaaaatctcaatgataaaaaatatctagaattttataataaattttgctcttgggaaaatggagaagcttctctaaaagtggcagaattgatcaaggcaagtaattaaggggatactatatgagtgcagtagggaatattaagttgctgattaacaaagtattaaacagttttgtttcaaaaaatggtagtatagcgtcgttttatgcaaaattaagtacaatcgatataaagaaaaatacgatactatatgaagtcagggatggtcaatcaattgtagactctccttttgcaatttttaagtatttagtgaatgatcccgacttcgctcattatcaccatgtgtgggtaatcaatgatttagattatcctactgttaataaaataaaagcttcttataagaatgttgattttgtagtgagaaactcaaaagaatatttgaaatggcttgcgtctgcagaatatttagtgaacaatgctacttttcaatctttctttgttaagaaaaaagagcaaatttacataaatacttggcatgggacacctttaaaatatatgggatttgatatcccaggaaatcctgctcattcgcaaaatgttgtaagaaattttttaatggctgattatattctatcgccgaatgctcacacaactgaaattttttcaaaaagctatcgattagacggaatttttcctggagtgattttagaaggaggctaccctcgaatagattgcactaattctattcaacgagaagtcatcaaagaagaattagatgagttaaacctcgtttttgatgataatttgccaactattttatatacgccaacatggaaaggatcttctatattaaatccctcaaatgatgaagaacaaattataagagaaacctatcttttaaaagactattttaagggaaaatataatgtattggtcaaggtacatccttatatttacaagacattaagcagaaatgagcgaatcaaacatattttgattccagatagtttggatccaaatgaggtattatcaattgttgatttattgatcactgactactctagcatcttttttgattttttggttacagacaaacctattattttttatgtttgggacagagatttgtatgaagcggatagaggaatgtatctcccagaaagtgtattacccggacctgttgctgagacagtcgatgagcttattgacctgatagaaaaaaaagatatttttgtggatcaatatagacaaaattatcgtttaatgaaagagaaaatttgcaattaccaagatggtaatgtaactaagcgttatgttgaaaggattttcaaaaaaaggaaatcagaaaaaattaaggagatacttcttagaaatgatctgaaaaaacttattatttatcctggtggcatgaaaaataatggaatcacaacaagttttattaatctaagtaacaatatagattatagcaagtatgatatttctattattctgaataaacctgtttccagtgaagaaataaaaaacttaaataagatcaataaaaatgttcgaatgctatttcgtccaggaaattcactttttactagaaatgaattaatcagagattattttattcagctcttttcattgaagaaagggtggcgcttcttgctaccagagaaagcttataaaagagaggctgcgaggattgtaggaaatattgcgtttgatgttgcaattgattttagtgggtatagctttttctgggcaaaattgattgcattcatgaacagtaataagagaattatttttcaacataatgatttattaagtgattcaaaaaaaatcattaatggaaaggctccgcataaaaaaaatctacctgcagtcttttccatttattacttgttcgatcgtattcttagtgtttcaaaagagaccatggaaattaacagaaagaatttaaaagaatttatcacggatggacaaattggttatacgacaaatacaattgatatatctaagatcatgacaagtggatctgtagatagtagtaatccaaacgccaataatcaagaaatatctaattttagatttacaggaaacatcattgccgctaaaacctatcaagtatatacaagcctatcactgctggaaaaaggagtatatttttccaaaacaattacagaagatgacgaaatttatgtacttgcatcaactttttataatatgaaagagtatgcaaaaattacagttaatggcatttatacaggttggattgaaaaaagatttattcaggcttctaacaaaggtatccaaaaggaagaaacaataatagaaaaccgctcaatgattgctacaattaactgcagcaatgatgaaatgatttattattcaatgagtgatttgaatagtattcgctcaccacttaaatatttaaataatacgtatgcttatattagtaaagagcagaaaattaatgacaccagctactgctacattgaaaacagcaatggagaaatcggctggattaacaaaaattgtctttcaaattttcatcaaacgtttcatctaagggctttaataaattattttttgaataaaaatgtcaaagaaaaaacaattgtgttagataagtttcagtctatatttattcaaggtcaattcaaaaataaaacaacaattggatggactgaaccagagccaattgctggaagcgaacaagtagccattatgtttgaaaaagacgatgtagctttatttacaaaaaaagcaacaattaatcagaaggattactattgtactaattcagcagaaggaaataaaatatggattgaagcaaaaaacattgaggaagcaagagtcaactcaatggaaattcaaagtaacttaattgatgaaagagccaagaatcagaagcggataagcggtcctaccatctcatctgactctatcaatttagttaatatgggcagattatcaccagaaaaaaatcaaatcaatttaatcaaggctatcaagcaaattattgaagatcaaaaaaatgtacgtttgtatattttaggagaaggtcctttaaaacttgagatgaagcagctaatcaaaaaacttgagcttgaagaacatgtctttctgttaggacatcaagaagatcctttttcgattatgaaacaatgtgatttgtttgtttttccttcaatctatgaagggcaacctatggtcttattagaggctttaacgttaaaacttcctgttctagctacaaatatccctgcaaatgtttcagttttgggagagtattctacgacctacattgaaggattttccgcagaggatattgcacaagctatactgaatagaatatgcaaattgaatgatactatgagatttagtcctgaagaatacaatagtgccgcactaaaaagtttttatagagaaatagagacttgaacaatgttaaactgaaaatttatgggtaaagaaaaagttatttaacttttactagtatcaaatagaaaggtgctttttatgataataaaacaacttaagaagactaaaataaaaatctctgaacaactatctttatggttttctgaagaataccagaaaaatgaagttgatacatcaatgatattttatgaatcaagagatggtaaaaatatgattgattctccaaaggcaatgtttgattatttgttaaacgatccttcttttaaagattatcaacatatctggagttatgtaccatcagaaattggatgggatgatttggtggaaagatattctgaaatgtcaaacgttttttttgtagaaagaaatactcaacaatatgtatcttatctatctaaaagcaagtatcttgttactaattcaacttttcagtctttttttgttcctaaaaaagagcaaatagttattaatacttggcacggaacgcctcttaagaaaatgggttatgatattgaaaatgcgaatccagctggatcacaaaatgtagttaggaattttttgtttagcaaatatattatcagtccaaacgcacatacatccgaggttttaaaaaatagtttccgactagatggaatcttctcgggcgaaattttagaatttggttatccaagaaatgacgtgctacaacgtaaggataattctgttttaaaacaattgatagatagaggaattgacatagatggaagtaaagaactgatcctctattgtccgacctggaaaggaacatctacattaaatccctccgattctctacaacaaattttggcagaaacatcttttttgagaagtcaggtgggtgaaaagtataacgttttagtaaaggttcacccgtatatatttaataaggcaaaagaagttgaggaattgaatagatatttggttccagatgatttcgaccctaattatgtattgttagtcacagatatattgttgacagactattcaagtatttattttgattttttggtaacgaataagccaataattttttattcttgggatagtgatatatatgaatccactcgaggaatgtattttgatgaaaatgaattgcctggtccaattgtaagcacgatgagcgatgtaattgattcaataaataagattgatcagataaaagacgagtacagagaaaaatatactgttgcaaagaagaagtttgttagttatgaagatggtttttcgacggagcgagtgataaattatatttttaaaaacaataggagttccgttggaagtgtcaaaaagatgttaaataacaaagaaaaaattttgatttatacaggaggtatgcaaaataatggtatcacctctagtttactaaatctattgaaaaatattgattatcaaaaatatgatgtgacgtgttttatgggtaatccaaatactagagaaaagctggcaaatgttgataaaattccaaaagaatgtcaccttattttcaaaccaggctatgctattcttactccagaagaaaacaaaacacttagaaacattacatcaaagaaaaatgtagataatataaacagcgagttattcccttggaaaggatttgaaagagaggcaaatcgaattttttctaacaacgagtttgatgttgctatagatttctcaggatatagtttttattggacgaaatatattctttcttcaaactcaaaaaagaaaatttgctatatgcatagtgacatgaatgctgacagacaaaaaatagtgaatggaaaacaagttcattataagagcttaggacaactatttagcgtgtacaatcgttttgacatgttacttgcagtttcacctgtaatggcagatgtaaacaaaaattctttgatcaacttcattcctgaagaaaaaattagttttgttttgaattcactagatttagataagctatatggtgatgatgttatatctactgaaaaaagaaatgtcaacataagaaaagtaaattttgaaattgatttaattgacaagcaagatgttattgtatgggaaacgtacaaacaagaattcagtaaaagaatcccatataaaaaagatatgaaaataaaagcaatcgcatatgcaaagtataaaaataacgaattatataaaattctaatggatgatatttatgtggggtgggttgaagcagaaaagtttgtaaaaaattatcctactatagtatcaaaagagccgtataagtcatatggatatataaaaaatgtgaaaaacaaagtattttggatagatttacctacgagtgattctagtaaaagatatggaacgactgatttttataaatatatgtatgttaaaattgttgaaaaagcaattttaagtaatggagatatgtatttccacattactattaataatgaaatagatggttgggtttatagcaatgtaataaatgaaacaattaaatttagtagaatcagaaaaatcaaaaatatttattctaattttcatagattaaaaaacccaaaacaatttccattgctgactcttaatgaagagggatacgtgaaggtaagagatatagctagtaacgatgccttcgaaaaagctgctaataatgaggatgattttgacttttctaatgtaaaaaataaagttcttaaatttaccaaaattattaaaaatcattacggagtgtattatttgatatatgatggaaataaaaaaattggttggttaaataagaacttcctaattgatctcatcgatgattgtatcgtgtcggagaaaaaagtaagtattgaaatctctatagaacaaggtacaataaagtacacagattgtttttttagtaaccctattgttaataacagttctaatacagtaatagttcattctgttattgaatccaccaaaggaactttcttttctgatggggaaaacttttatgaaacaaaagatgttgaagtcataaaagaatttggtaagtatgatctaatggggaactttgttcctatgcctaaaaatcaggattttaacattataacaatcggaagactatccgtggagaaacaacaagacaaattgatttatgcttttcaaaattttaaaaagactatcccgaatagtaaactgtatatattaggtgatggtatcttaagagaagaactgctatctattgttaaagaaaataacttagaagattctgtatttttattaggacatgtatctgacccatttacaattttaaagcaatgtcaactttttactttaacatcagcatatgaaggacaacccatggttctacttgaagcactatctctgggaataccagtttgttcaactaatatacctgcaagcaagtacgttctttcagatggaaaatatggaattctatcagattctaacgatattgatggtatagagggcatgctgtttgagtcatatagtcataagcaaaattttaaagagtttgatgcaattaagtataatatagaagcagtgaatatgttttatgaaaaaataaatagctaaacagtgaattgtaaaagaaaattctatataaaaaattgtttcgaaggagaaagattttatgaagtactttgtatctggtggcgctggttttatcggatctacattagtaaacagattaattgaagaaggtaatgaggttatcgtggttgatgatctttctatgggaaatgttaataatcttattgataacaaaagattgacatttttcaaggcagatataagggatatagaattggttagagaaatatttaaaaataatagtttctcttatattttccatctagctgcagttgcaagtgttgccgattcgatagagagaccatttgaaacacaccaagttaatatggaggctacacttgacttactggaattagcaaaagagacccagaaaaatctaaaaaggtttgtttttgcttcttctgcggctgtttatggagacgatcaagtcttacctaaatcagagatttcgagaataaagccgttgtctccgtatgcaattgacaaatactcgtcggaacaatatgtattactttataatacgctgtatgggttaccgacaagtgctgtacgattttttaatgtttatggtccaaatcaaaatccttcttctccatactcaggagtgttgtctattataacgaatcatttcaaaaaaataagaaataatgaaaaagatgtgtttacaatttttggagatgggagtcaaactagagactttgtctatgttgaggatgttttgcaagctctaaaattggtatcagaaaaagaagaagcactaggagaagtgtttaatgtagggactggcgctcctagttcgattaacgatgtacttggtatatatgaatccgaaatgaatatcaagcctataattcagtttgaagagtctagaaaaggtgatattaaggattcggttgcagatatatcaaaacttaagaaaattgggttttcacctaattatagtttagatgaaggaatagctgagtatttaaaagaagaaatacaatattgataaatgttaaatagttgtggaatggagtaaatctcaatgaaagtgacaaggtccaatagttcgaaatctctcaatacggaaaagatattctcctttatgctagtacttctttcatttgttttaattttactaactttgaattcaaatgttttttcaaataggatagacgctcatgattcttccatgtttctttatttcggaaaaggaatatcggaaggattgataccttataaagatatgtttgatcataaagggatagtattattttttattcaatatatagctaatattgttggattgggcaatatatttttgggaatatttttagtggaggcagtttttttattaattgctttaatttttctttacaaaacaagttatcttgtttcaagaaatcatttgatatgtggagttgtaatattgatttcttctggattattttctgaattatacgaaggtggaaatctttctgaagaatatgcattaacttttatctctatctcaatgtactactttctgaaagagataatcggtgattcattaaaaagttaccattactttcttttaggtctaatgggtggtttagtattttttatacgtctaaacatgatttctctttgggtagtcttttgcataggaatagccgtaagagaaattataaaaaaaagttttgtttctctttttagaaaagctttttacatttttcttggtggaatgtctattgttttgctcattattgtattctctataatgacaaattcagttgaggaaatgatttttcaaacattcacattgaacatgcagtactcttcaacatctctaaaagaacgagtggcagcgtttatattcttcttcggtttattttcagtatatggtctgcctatttggtttacagttttgttttcaaaaattgttattaaatatagagaaatagaggtggagaagcggtctgttattgttttaatcctaatagcactgattttaaatctatttacgattgttgtctctggtagaaattatcgtcattacggaatcacggaaattccttttctgattgttttacagtgcatcgcaatgggattttactcaaaaaaatttagtaggaagaaaaatcttatagttatgtttgtatttcttttttccatgctacctatattcttgccaaccgtaggtgaacgtattaataatgttaatagaaaagaaacgccttcatatcaatcggaacaattagatattgccagatatataaaaaatcattcgaacgaggatgaacaaatttatgttcatgcaattgatgcaaatatatacttacaatctaatagattctctaattccaaattttttgtgcttccttcgctgaattatgaagaatttccaaagttaaaaaatcaatttacaaattctttacaaaaaaatcctccaaagtttattgttatttcaaaaaattcattcttagaggagcatccaaacgatagaaaactaaataagattttaattgaaaaaatcaaacaagattatcacaaagtagacgcattcgataagagctactatgtttttgaaaaacagtagcttaaaatcggtgagattttcatcaatacaacttacaataatgttaaactagagtacgaaaaatatttattttattccactcctcctaactttcgtgtataatggtacaagtcagtattacgaaagttaggaggagttgttttgagtaaacaacatccagaagagaagtccttcaaagacgaagttttaggtgctttgaaaaaacctcaaaccaacgaatcgtctgaacaaaagcgatcatctgttgaggaacctatagaaagtcgctctgcgacccgcagtacaaaaaagcagagcagtatccaaaagggccaaatcaaaaataaaactgttcaaaaaaacgctcaaaaagcgaagcgttcagctcctaaaaaggaagaagctggtttagatgaaaagtcagataccgttcgtaagttacagcggaaaagagaagaccgtatcgtcaatcgcatcgtcacaattgttgtaatcgcattaatcgttattggcggcgtccttggtttttcagtctatcgatatgtcacttcaggattgcagccgttagatccagaaaaaacagaaaaagttgctgttgagattccaagcggatcatcaaataaaatgattggcgagattttagaaaaagataagatcatcaaaagtggtatgatctttaattattatacgaaatttaataatctgactggtttccaagctggtaattatcagttttctccaagtatgactctggatgaaattagtgcccagttacagcaaggagaagggtcagtgacatcagatgcgaaagtgacgattcctgaagggtatgatatagaccaaatcggagatgcgcttgccaaagcaacaagtatctcgaaagatgatttcttagctttaatgaaagatgacaccttctttaataaaatgcatgaagcatatccagagttgttggatagcgcggcaaaagcagaaggcgttcgctacaagttagaaggatatctcttcccggcaacttatgactattataaaggaaacactttagaagaagttgtgacccaaatgatcgataaaacaaatactgttatgtctaaatattacgatcagatcgcagaaaaagaaatgacagtgcaagaagtgttgaccttggcttctcttgtcgaaaaagaaggtagtaaagaagatgaccgtaagaacattgcccaagtcttctttaaccgtctggcagtggatatgccattgcagtcagatatttctattctctatgcgttaggcgagcataaagagttggtaacttacgaagatactcaagtagactcaccatacaatttgtatgtcaacacaggatatggtccaggaccattcaataatccaagtgagcaatctatcaaagcagtgttggaaccaacaccaaataattactattattttgtggcagacatcaatacgcaagaagtctattttgcagaaacctatgatgaacatatgcgtttagttgaaaaatatgtaaacaatacttcgaattaatttttattaggatattagtttacatttaaaaaaaaccatggtaatcttttgtggactattcgcaaaagattaccttttgcagttgatacgaagttaaaaggagaaattaaaatggtagaaaaagtatacccaatgacattagaaggaaaagaaaaattagagcaggaattagaagaattaaagacagtcaaacgtggagaaatcattgaaagaatcaaagttgcccgcagctttggagatctttctgagaactctgaatacgaatccgcaaaagatgaacaagcctttgtagaagggcgtatcaccacattagaaaatatgatccgttttgctgagatcattgataatgaaggcgtagacaatgatgaagtatcgatcggaaaaaccgtcacgttcattgaattacctgatggagatgaagaagaatatacaatagttgggagtgcagaagcggatccattttctggtaaaatctcaaacgattcaccgatcgctcgtgcattgattggtaaaaaaatcaatgatgaagtaacaatttcaacaccaggcggagatatgctggtgaaaatcacagaagtgaaaaaaagctgattttttcgtaaaagtctaagcagaagatcctgatgatcactttctcaaagagaaaaggaccaatcaggatcttttttcggactcgcgacggatgtatgccatcgaagaatccgttatgataaaatagaatcattgggaggaggagcttacatgaaaagcccttggcgttttttctttgtcgtagaagcattattatttctatttgcggtctggcaaattttatcgaatccaccgttattgattttattgattttaggtgttgtgacgatctactttgtttctcgcagagaacgtaaaacaaattttaataattttttgatggttaccggtggtatcgccatctttatcagtcttttaaatagtccggctttgtggctgatgttgatttttgcgatcctttttattggattgaaaggtgtggaaatcactggtgtagattttacaaaaaacacattttggcgcaaaaaacaaatgatcattttagaaacagaagaaccaaagcagtttcatcctcataaaacgaaacaacaatggatcggcaatgagcggatcgggaatcaagtgtatgaatgggatgatatcaatatcgacatcttttctggagatacgatcattgacttgggaaacacattgttgccgaaaaaagaaaatatcgtaatcgtccgtaagggattcggtcgcacgagaattttagtccctgctggggttgctatcaaaatggaacatagcacctttatcggtacagtgattttcgaaggcgagtcaacaggtctgaagaatgagaaagttacgatctacagtccggattatgaggaaaacacccgccgactaaaaattttaacgaacactttgattggggatatcgaggtgattcgggtatgattgctaaattttctcgaggaatgatcgctttttatagtgcggtcactagttttttgatgatgatcttgattcttttttcgtatctttatgctagtggaaagaagaattggctgctagaagtctttcagatcaaactattctttataccgatcatttttcatttattagttgtttcgctgatggtgggcctggctgtctttctattgatttctcttttcagaaaccgccaatacgggccaatcgaagagaagctgcgattgctttcaaatggagatattgatagtccactacttgacacacctatccctcatgcgcaagaaaatcggttgattgaagatgtcgatcgagacatcaggaaattacaggtcaaaatgaaagatatgtcaagtgagcttcaacaattaaatgctcggccgcagctagtggatggcagtacaaaagaagaaatccttgaagccgaacgacatcgtttggcccgagaattgcatgattcagtttcacaacaattatttgccgcaatgatgatgatgtccgcattaaacgaacaagccatccgggacgatgccccggaaatgcaaaagaagcaattggctatggtaacggacatcatcaatgcttcgcagtctgagatgcgagcgttattgttacacctgcgtccggtcacattggaagggaaaagcctcaaacaaggaatcgagcaattattaaaagaattggaaacaaaaatcaagatatccttgaaatgggatatcgaagagtttactatgccaagctctatagaagaccaattatttcgagtgattcaagaattactatcgaatacactgcgtcatgccaaagcggatgaacttgaagtctacttgaatcatattgaacacaacgtgctgttgcgcgtgatcgacgatggtgtaggattcgatgtcgacaatcaaaaagctggcagttatgggctgatgaatatccgtgagcgaatcagtgccgttggcggcacattaaagataatcagttttaaaaatcaaggaacaagtattgaaataaaaatcccgctgcttaaggaggcataaaaatgatcaacgttttgttagtagatgaccacgaaatggtacgtttgggggtttcttcctacttatccattcaagaagatatagaggtgattggagaagctgaaaatggcaaaatcggctacgaaaaggcattgtctttacgtcccgatgtcatattgatggatttagtgatggatgaaatggatggcattgaggcaaccaaagccattctatcagattggccggaagcaaaaatcatcatagttactagttttattgatgacgagaaagtatatcctgcaattgaagctggtgctgccggttatttgttaaaaacatccactgcacatgaaattgcggatgccattcgtgcgactcaaagaggcgagcgggtgttggaaccggaagtaacaacgaaaatgatggatcgtttaacaaatcgcacgccgattttacatgatgatctgacaaatcgggaaaaagaagtgctgcttttgattgctgaagggaaaagtaatcaggagattgcggatgagttgtttattacactcaaaacggttaaaacccatgtatcaaatatattgtcgaaactagaagtggaagatcgaacacaagcaaccatttatgcctttaagcatggcttgacaaaataagaatctcatcataagggtacctcctcatagtcagttgaggaggtttttgatatactagagtaggatttgtaaggtaaaggagcgtttaatgtgaagcagaattacgcgattattggtcttggaaggttcggcggcagtatttgtcgaacattgatagaatccggacaagaagtattagccattgacagcaatgaggatcgggtcaatgagtatatgaatattgctacccatgcggtggtgggcaatgcacaggatgaaatgacgttgcgctcattaggaattcgtaatttcgaccatgtgatcgtagcaatcggtgaagatatccaagcaagtattcttgtgactttgatggtcaaagagatgggggtaccgaacgttttagcaaaggcgcaaaatgaatatcatgctcgggttcttgagaagcttggtgctgatcgagttgtccacccagaacgggatatggggattcgtatcgctcacaatctagtatcaaaaaatatcttggattatattgagctttcagatgaattttcgctggcggagattcgtgtctcaaatccgcgtttctttaataggtccttacttgatttgaattttcgtcaaaaatatggattgaccgttgttgctattcgtcgaggacctggacaagtgatcgtgtctcccgcagctgattcgatcgtgcgtgagaatgataatctactcgtgattgggaacacggatgatgtggatattcttgatgaacatatgaatgattaggagtgaaaaatgatgaatataactattacagaagccgcaattgattggttcaaaaaagaactgtcagtcgaccaaggaagcggcgttcgcttttttggtaaaatctatgggaaaactcagatccatgatggtttttcagtaggaatgtcagtagataaacctgaaaatcctatcgttcaaaagacagtttcagacatgcttttttttattgaggaggccgacgagtggttcttcaaagggtatgatctacaagtcgactacgatgaaaagctagatgaacctaaatatagttttactgaaaacaattaattaaaataaagatacaatgtaacagtatgagtctatgactgaagtttagtggattccatatcgctagctttgatcatagacctgttcgttaggagatgaaaccatgttatcaattatcgtaccttgctttaacgaagagagtagcttaccacttttttttgaagagactgaaaaagtaaaagatcaggtaggcatgccttttgaatatttgtttatcaatgatgggtcatccgatcaaacactcgcagtgatgcgcaagctgcatcaagagcatccagaaagtgtgcggtacctttcgttttcacgtaattttggaaaagaagcagccttgtatgctggcttaaaagcagcaaaaggggattttgttaccgtaatggatgcagatttacaagatcctccacgccttttgcctcagatgtttgacttgctcaacacaaaacaattagactgtgttggaacgcgcagagccgatcgcaaaggggagcctaaagttcgtagtttcttttcagaagccttttatgcattgatcaacaaaattggtgaagcacatatggtcaatggcgcacgagatttccgtttaatgcgtcggaatatggtggatgcagttttagaactttctgaatacaatcggttctccaaaggaatctttagttgggtaggttttgatacagaatacattgcctacgaaaatcgtgaaagagtagctggagaaacttcttggtcattctggagcttattcaagtactcgattgatggcatcgtcaatttttctgatacgccattaaatattgcttcttttgttggcgcgttgtcttgtctagcttctggaattgcactgctattcataattattcgtacttttatttttggtgatcctacctcaggctggccttctttagtttgtatcgtattgtttgttggcggtttgcaattgctttgtctaggtattattggaaaatatattggaaaaatttttctggaaacaaaaaaacgtcccctttacattttaaaggagacagaaaaagatcaaaaataatttttgggaataaaaaagcagcgctggttgatgatcaatacccttttgttacatcgacttgatttcgaaccaattttttctcgtggataaaattgcggaagttatccataaagatggccatgaatgctttttgaaaatgtggggtcaacccggaaatatgcggggtgatcaacacattttccagtgtccatagcggatcatttgcgggtaaaggttcttcttcaaaaacatcaagagccgcaaatgcgatttctttttggcggagggcttctgtcaacgctacagtatctacactgggtccacgcccaacattataaaaagaagcggatgatttcatactattaaaaaaatggctattatagattcttgtagtttcaggtgtcaatggtaagatattaatcacacaatcagctttctgactttgttcaatcaactcttcaagtggataagtttccttgaaaccatcaacggcatgccccgttgtatttatgccgacaggttgggtgccaaaaaaatttaaggcctttgctaaagcctgcccaattttacctgtacctgcgatcagtatttctttatcagataataatgaataaggaataccattgggctgccattgtctttcagcctgttttttgatggcggtaaaaattcctctggattccatgaataataaagcaattaaatgatcagtgatcgattgtgcatgaatgccgctaccattagaaagtaagatgttcttttgggcaaactgtgctagaggtagcgtatccacaccggctgaaatggcttggacccattcaagagaagcattagccagtaactttccagcccattcttctttccagccaatcgtgattgcaacatttgaccagtcgatggaagttgcttcatcatagtggataaactgatattcatcactgatttcattaatttgtgtgataaattcatcacgaaattctctgctagataaaatatatttagtcatatttgttcctcctttattttagtgtatcaaagaacaaagaaaaaaccatgcgcaaagatctatgcatggttggatagttactagctttttaattggattttaggcgaacctttgacgccttgagtgaatagaaacagtgctgcgaataagataaatgttgtcccatcaaaatttggtacgaatagttggatcagcacactcaaaattgttggtaaagcagcactaacgattagtatcttaaggttttcaaaaaagctgtaagaaaaaagttttagttttgtatagatagttgcaataaatgtacccatgatcaatgtgattaataaatttaaaaatgtagggtagagcgctactaagaaaacaataagttgtagccaccaaggaatttgattgctgctcagtgtttcccgaatctttttgccatctaaattattaaatgctggttcattataagaaaattttaattgatttgtatctaagaatgatgtggaaagtcctgttccagggaaactgacaacaatttctttttttaatagtcccacactcaacacatttgcagtggcatctgaagcaatatcggtagcgttgcgttttccttcagggtcgaaagtaaaaatgatagagtcggtttgatagataaacccttctccttgtccattcgttgttaattgaccattttcaatcgaaaaattggggattttttgcgcaattttttgactatctcgctggaaatcctgaaagatatcattgacttgcaaagtgattggtacggctaaaataacggtagctccaagtagaaaaagaatcacttttgaaaaagcagcgtcttttacatatttgagatttgggattcgaataaatgcactttttagcatttgtatgattgtcatttgtttaactccttttatgtaactaaaaataattgtaacgaaggcagcaacagaacacaaggacttatgacagaaaagtccgattatctctaaagtgttctttgctgattaatgagtagaattggagatcgagtatggaaagtttaaaaaatgtgaaaaataaactacaagaaaaaaaattatgggagccgttaacgtatttaatttttggtggattaactactttggtcaatttagttgtttattttctctttagagaaatctttgattttcattatatgattgctaatgtgatttcttgggcagcttctgtgttgttcgcattcttcacgaataagatttgggtctttgaagcaaaaagtgaaacaaaaaaagaatcgtggcttgccttttggaagtttcttttcttcagagtcctttcgctgggattggatatggcttgtatgtatctattgattagcgtactaggaaccggtgattttatcgctaagcttgttacacaaatcattgtcgtcctagcaaactatgttttcagcaagtttctgatttttgcaccaaaaaaaattgataaaaagtaagcatatgttttgatgaaccactttttatctgataatgttacttatgtaatcactatcactgaggaggaattttttatgtcttacacattaccagatttaccttatgcttatgatgcattagaaccttacattgatgaagaaacgatgcatttgcatcatgacaagcatcacaatacttacgtcacaaatttgaatgcagcaattgaaaaacatcctgaattaggtgaaaaatcagttgaagaattacttgctgattttgattcggtgcctgaagacatcaaaacagctgtccgtaataacggtggtggtcatgcaaatcacagctttttctgggaaatcttggcaccaaatgctggtggtgaaccaacaggagccatcaaagaagccatcgaagaaacatttggcagctttgctgatttcaaagaagaattcaaaacagcagcaactggccgctttggttctggctgggcttggttagtcatcaaagatggtaaattagcgatcacttcaactgcgaaccaagattcaccattaatggacggtcaaacgccagttttaggcttagatgtttgggaacatgcctactacttgaaatacaaaaatgtacgccctgattatatcaatgctttctggagtgttgttaattgggataaagtaaatgatttttatgcgaaagcaaaataatcattaagtaagggaattatttttaatcagaataaaactatcccaacgataaaagaaagcacgttgcatcttagcatcagcttcgtgttaaccataagttctcactgctacctttgattcgttgggggtagttttattttttgaaacatattgctaacgctttcattttcagctataatattgaagacggaagcgtcttattttaattactggaggatttacacgcatggaacatggaaaagtaaaatggttcaataatgaaaaaggttttgggtttattacagttgatggcggagatgatgtctttgttcatttttctgcgatccaaggagatggctttaagtctttagaagaaggtcaagaagtcgagttttcgattgtcgaaggcgcccggggaccgcaagcggcagaagtcacgaaaatctaaactagaacaagctgagggggacctcagctttttttaatttgctattttcggccaaatttgttatcttcagtgtattataaatagattaaaaatgagggatatttgatgaaacgagtaattacgtatgggacatttgatttgctccattatggtcatatcaatttattgcgccgagcaaaagaacaaggagactatttgatcgtggcattgtctacggacgagttcaattgggatgaaaaacagaagaaatgctacttttcttatgaaaaacgtaaacagttattagaggctattcgctatgttgatttagttattcctgaaaaaaactgggaacaaaaagtttctgacgtcaaagagtaccacgtggatacttttgtcatgggtgatgattgggctggtaaatttgatttcattcaagaagaaacagatgccgaagttgtttatttagctagaacgcctgaaatatcaacgacacagatcaaaaaagacttaaaaataaataattaatacttaaagcataaaaggtatctttaaatggtgcctttttttgtacactatttccgtttttttcttaaaatttattagatgtttttcgttgtttattttgtcttagaggaaaatatgatatgatgtagcttgagttgtagcaaatgaatagaatttctttgagaatggatgaagaaagtggaaaaagaaataaaagttcgtagtactttggttacaaaggaatatgacctatacaaaaagaaatcagacaaagtgaaagcattattcaaattttatcatcgaaatgttccacgtttttgggcattaaaaggcgttagttttgaagtgcgtgcaggagagtctgtagggatcattgggataaatggttctggaaaatcaacgctttcaaatgtgatcagtggcattattcctccaacatcaggcacaatggaagtcaatggcgatacgtcgattatcgcaattggagccggattaaaatatcaattgacaggtttagaaaatattcgtctaaaagcattgatgtctggaatgaccaataaagaaatcgataaaaaaatggatgaaatcgtagcatttgccgatttaggtgattttattaatcaacctgtaaaaagctattccagtgggatgaagtcacgtttagggtttgccattgctgttcataatgatccagatattttgatcattgatgaagctttatctgttggagacgaaactttttatcaaaaatgtgtggataaaatcatggaattcaaagagtccggcaagactattttctttgtcagccatgctttaggacaagttgaaaaattatgtgaccgtacaatctggatgcattacggcgatttgcgcatgtttggtccgactgaggaagtaatggcggaatatcgcaagtttatcgactggttcaagaagcaaccgaaaaaagaacaaaaagcttaccaagataaatacaaagaaaatcaaaaggcatttaatctagaaaaattagctgaaaaaagccaagatgatagcttgctgaaagagcagcatctatctgaacaaatgattcagaagaaccttaaacgaactcctttaggtgagaagatgacgattccaactaaaggacttttgactcttgcgatagtaggaacactgttttgctctcttgtttctttcagtggcagatccattagctatgcgctaaagcatccggttgatgcaattgtacaagttttcaagtaaagataactatttctttatttagtttagatagaaaaggaagagtttagtgaaagaaattgctgcagtaataaaagaacaatttaatcatgcgggaattattttccgtatgtctcgatacgaggacaaagcaacctatcaaagccactatcttggtcttgcatggcaaatcttgaaccctgcgattcaaattggtatctattatttagtctttgggctaggagtcaatggtaatcggaaagtagatggcgtaccatttattatttggatgttgattgggatcacagcttggttttatatcaattcttcggtacttggagcgtccaatagtattcaccgacaagttggtatggtagccaaaatgaaatttccagtaagtatcttgccgtcaatcaatattatcagtaacttgtcatcttatatccctatggtagctattgtgattggctcgctcttatgggcgggagtaacaccgtccgtttattggttgcaatttatttattactttattgcgatggttattttcttatttgctttcggattattaaatgcgaccattacagtattgatacgtgactatcatattttcttacaatcagtattacgtttgttgttttatgtttcaggaccaatttgggatatcaataatcgaaatatgccggaatggttaattaagctattacgtttaaatcccttttattatttgattgaaggctttagagatgcctttttatcacgtggttgggtttgggaaaaaacgacctacaccttaattttttggggaatgactttaacactattgataataggtagtcatctacacatgaagtttagagcgcgatttgtggattatatttaagtataaaaaaactatttttcaattaatacaaaaaactatccgaaggaatgaaggggtctgttaaagcgtgtctcttactttccttaggatagtttttttagatgtgttaatgaatagggatgtacgccgttaaaagttaaaataacaaattctttatcgtttcatttttgttgcaatcgtgttaagattctgtaataaaacagaagcaagattgctgaatttgtaaaattgtggcaaaatttaaacgattacctaataatgttgtgatagaggtgtaggatgcgtttatatcaaaaagtaattttaggattgttgggcttggtggcagtaagtattgtcggtgtcactgtctatggaatgaaagtatacgatgatacgaataaaacgttcaataatattacgcaaagtgcggatcgtaagacgaaaaaacgtgaaacggcagtaagtattgaagatagagaacccttttcgattcttttgcttgggattgatactggagcgttggggagaaccgaacaagggcgttcagatagtatgatggtcgttacggttaatcctgccaagaaacaatcaacgatcgttagtcttgaccgtgatatctacactcaaattgttgggtatggcatgttggataagctgaaccatgcatatgcctttggtggcgaagcaatgtcgatggattccgttgaaaatctgttagacattcctattgaccattatgttacgattaacatgcaaggtatgcgagatttgatcgatgcagttggaggcatcgaagtcactaataaaatcgattttactctggaaggagtgcatgtgcctaaaggaaccattactttagatgggaaaaccggtcttgcctatgcacgcatgcgaaaacaagatccggaaggcgacattggacgtcaaaaacggcaaagagaagttgtcactaagatcgttaaaaaagtaatgagcttggatggcgtcagcaattatcaaaaaatattaaaagctgttgaaaagaattcaaaaacagatttgacttgggatgacatgatggatatcgctaccaattatttgcctgcgttcacgacaatcgatcaagaacaattgcaaggtgaaggccaaatgatgaatggggtctattaccaattattaggtatcaatcaattgctggaaatgcaaaataaattgaaagaacaactgaatcttcctaccagcgagactttgtctcaaggagatgaacatactgatggttatacaaactatcaattgtacgacgatacgaattacaatagtgaagaaaactcaaatgagaatccaggtgaaccgtcagacatttatgatgatggagccgggtatcaggaagatactgtcgattactctggatattaataatgaaaaccaaagcaaacggtcattgatcgtttgctttttacttttccacagatggaagttagaaaaatgtgtttcacgggattaaaattggaaaagattaagaaagcttaaagtgtagcagattctttctcaacaaaaaaatctttttgcgtaactgtgaaacattacagtggatgagaacgaattcttataattttctctaaggatacttggataattttgatttcttctgtttatattgaaaatttttggtaaaataagacggtaagcagtttgtaatgagaggatagaagagatgaagaatctaaaagataaagtcattaagaatatacgaaaagggcctgaggagcctaagacaaaatcttatcgcaaatcccatgttccctttcgattgaattttctcttttttgtgatttttggtctttttgttgcgttgatcgtgcaattaggttatttacaaatcgtcaatggtgataatattgagaagcaattgaaagcttcatccgtggtagaagtcaatggcagctctccacgaggaatgatttatgatgcatctggcaaaccgcttgtcaaaaatcaagccaatgcagccattacctttacaagaggaaataagatgacagctgaagatttattgaagactgcacaaaaactagctacattgatcgatattccaatcgataagaatctgacagagcgggacctaaaagatttttggttggcagatcctgaaaatttgaagaaagcgcaagatcaattaagttccaagcaaaaagcgctcggggcttctgatcagtatgcggcaactgtcgataaagtaacggatgaggatattgcctttaatgatgatcagttaaaagtagcttccatttttaaacgaatgaatagtgcacaatctttaagcactgtttatttaaaaaattctgatgtatctgatgaagaactagcaattgtggctgagaatatgaccgaacttcccggagtttcgactggcacagactggactagaaaaattgttgaaggcagttcattggcaagtttgatcggaactgtgacaacagaagaacaagggatccctgaagaaaatttggatgaatatctagcgaaagggtatgctcgtaatgatcgtgtaggacgaagttatttagagaagcaatatgaagaagtccttcaaggatcaaaatcaaagtctcaaatcacattagacaatagcaataatattgaaagccaaaaagaaatctatgcgggctctaagggagataatcttgtactgacgctagatgccaagttccaaaaagaagttgatgaaatcttacaagataactttaagtctttgatggattcaggagctgcagaatactcgcctggagtctatgctgttgcgatcaatcctaaaactggcgggattttggcaatgtcaggttatcaacatgaggcagaatcaagcaaattgcaagagaatgcaatcggaaccttcatcaatgcttttgttccagggtctgtagtcaaaggtggtacgttagcagctggttgggaaaatggtgtcttgaatgggaatgaagtcttatatgaccaaccaatccgcatcggctctgatgtcaaagcttcgatctttaacccgacaggagcaaacaaccgcaatttgtcagctgaacaagccttagaagtttcttccaactcctacatgatgcaggttgctttacgcttgatgggcattgagtatcagcctggaatttcaattccaacagttgatcgtcaaacagaagcctacagtaagctgcgtacagcctttgcctcttttgggatggggacgaaaacagggatcgatcttcctggcgaagcaacagggatcagcacacctgtcgacaaattagatacggtcagtgatggcggtaagatcctggacttagccttcggacagtttgatacctatacgacattacaattggctcaatatgcagcaactgtggccaatggcggccaacgattgcagccacatatcgtttcgggtatctatgggaatgatgaaaccggtggtttaggaagcttgaaatcagcggtagaacctaccgttttgaacgaagttggtttaactactgatcagatgaaaatcattcgaaatggattttatgatgccgttcatggaacagatgcttgggctacagcaacaggactagcttctgctaaaatggaactttctgcgaaaacgggtactgcggagacaccgattgtcgatgaaaatggcaaaaccatcaatctggtcaacctaaatattgttgcttatggaccaagtgatgatgcagatatagcagttgcagtggttttaccacaggttaaatcttcaactacttcgcatccaaacgtaaaaatcgtgaaagaaatcatggatgcttactatgatttatatatgaaataagcaaggcataatcgttgaatgagtaagagggagttgatgaacggttcgttcgctgatgattttccaaatcagtgaaggacggttcatcaactttttttatagcaaaatactttctatcggaattattaagagattatcaataattcggagagaaacctcttttttagtaagtgggtcttgctatttttggttgaatggcatagaatactctcggtcaacaagaaatgaaaaagcaggattggtttcaatcatttttcattttaactgacttctattataattgactagaattgcagggggctatcatgacgaagcaatgtttaacgaaacaagaattgatggaacgcctaggggagttctcaccagcagaaaaaaaagaaatccgcgaatatttgcaacggaagaatccattgctgtttcgcaaatttgaacgcatgaaacatgaattatttcgtctagaatcaagacggattcaatgtgaaatcgaaaaaaatgaaaaggagttgaatcagctcgatcataagattctcatgaaaaaagaacattttcttgagttattaatcgcaattcgaaagaaaagaggataatggatggaatttattgaacttatcatcatcatcgcgatcctcgtgaccttttcaaatattgtcagcaaaatactgccatcagtaccgattttcttcattcagattatcttaggcattctgctaggattgactgaaatgggacaagaaatcgcattcgaaccagagatgtttctagtgatgatcattggaccgctattgtttcgagaaggagaacgagccgatgttccggaaatcttgaagaacagtaagatcgttttgtttctggcctttggcggtgttttgctgaccttatttgcagtgggaacgacactgcattggctgatgccatcgattcctttggctgcttgttatgcttttggcgctgccttaggaccaacagatgcggtagccgtctcatctttagcgaaacgcttaaaaatttccaagaacatcatgcatattttagaaggcgaaggtcttttgaatgatgcttccggggtaacagcgctccaatttgctatcgttgctttagtcactggtagcttttctgttatgggggctggctttcaattgcttttttcgagtattggcggcggcttgattggttacttgatcgtttggttaaaacggcggatcattcgctttattgaaaaaatatctgcccaagatgtcactgtttatctgttgatcgaactactattgccttttgcagcctacttgattgcagaaatggttggagtatctggtatcattgcggcagttgttgccggtgtagcgcaagcacaaagaagacgacgagtctctttgttcgatgcggaactagccaatatctctgaaagtacgtggtcaacaattgtatttacgttgaacgcccttgtttttttatttttagggattgaactttcgcaagtattttcacccatttgggaaagcaattcttatgcaaacggtcatttagtcttgaccatcgtagtagtaacactcgttatcttcttcattcgtttcttattccttcttttttattatcagtttttacaatcaaaaaaaatcgtggacttgaagcaagtagctttgttgacctttggaggggtcaaaggaacggtcagcttagcggcaatttttatcttgcctgtaacgatcaacggtgaccaatttgaagcccgcagtttgctcttatttttgacggcttgtgtcatcttagcgactttagtgatcagtgtacttgtcttgccctatttggcagatggtgaagctgccgaatctgttgatttcaatcagttgctgattttagaagaagtcatccagatcttggaagaagaagagaaagaaattacggatgccaaagagcgcttagcgacagatgcagtaatcaatacttatgaaaatcgacgctgggaattgtatcgcaatagtttaactgattctgaaaagcaagagatacaggaaattcaaggattgattctatccattgaacaggatggtttggatgaagcctaccgaaaaggtgaggttagctccaatgggtatcgcttttattcccggttcatttcgcagcagcagcattcgttagcaaaacagttcttgtcttttttcagtttttggcttttgatcattcaacgttttgtacggatcatttttcatcccaagctgttttggcagcgccagcagcagctgaaggatgcattgaaacaaagagatatatcagaagtacaaaaaatctatatcaaaaacagtgattatatttttcatagtttaagcaacttagaagatgtctacgattcatctttgatcaacttctttatacgtcaaagggaaatgagcttaaagcgttttgagcataataacttcattgagactatcatgattgaacaagaaccgatttttgtcaaaaaagttttacgaggctattatttagaacgaaaaacgatcgatgaatatgaggtagccgaaaaaattccaacgatctctgcaaacgaatatcgacgcaacgtaaatctcttggaatcttatgcgatggctcgcgcagatgaacagccgaaacagcgaatgtttcgtagataaaacaacaacttcttcgtctcagggttgagatggagcggttgtttttttcttttttcttaaagaccctgtcatgcttatgtggtacaatgggcgaagaaaaatagatctcaggagggattctgtgaaagaattaaaagtaagtgagcttacaaaaacttacggcgataaaacattatttgatcagctttcttttctgatacatgagaaagaccggattggcttgattggtgtcaatgggacaggcaaatcaagtttactgacgatcttggctggaattgaagccggagatggcgaccgtccctctgtttttaaaccacaagattatcgaatcggctttttggcgcaagaaagtcaattaaaagaagaattatcggttgttgatgcggtcttccaaggaacaagtccattaatcaaaaccgttcgtgactatgagaaagctttgattcagctggaacaaaatggctcagatcctacagtgcaagctgcctacagcagagcagaagaagctatgaataaaacagatgcttggaatacggatacaacggcaaaaatcattttgcagaaattagggatttcagatttaaaacaaccagtcaatgaactttcaggtgggcaaaaaaaacgggtggggttagcgcaagtgttgatcgatgaaccggatttactattgttggatgagccgacgaaccatcttgactatgaagctatccaatggctagaaggctatttgaaaaactatcgcggcgcactgatgatggtcactcatgatcgctattttcttgaccgggtagccaatcgcgtgtttgaactctcttttggtaaactttatgaatatcaaggaaattacgaggactatttattagccagagcagaaagagaacgtattgaagaaacccaagaagaaaaacggcaacagttatataagcacgagctggcatggattcggacaggcgccaaagcgagaacgactaagcaacaagcgcgaattgatcgtttcgacgatttgaaagagaatatgaaccaagtcaagcggaatggagaagtgcagattgatgttgcgacctcacgtttaggtaagcaagtgctggaaatcaaagaaggtagttatgcaattgaaggcaaaccaattctatctcaatttgatttattgattcagtcgcgagaacgtttaggcattactggtgagaatggtgcaggtaaatcaaccttgctgaatgtgttggcgggacgtctctcattagattcaggaagacggattattggctcaaccgtcaaattagcttattatacgcaaaccaatgagacgatggatccggaacagcggatgattgcttatttacaagaggcagcagaagaagtagaaaaaacagatggtgcccatgtcagtgtagcggaaatgctggaacaatttttgttcccccgtttcatgcacggaacaaagatcggtaaattatctggtggtgaaaaacgccgcctatttttattgaaattattgattggtcaaccaaatgttctattgttggatgagccaacgaatgatttggatattgatacattaactgttttggagaactatcttgaatcatttcctggtgccgtaattacagtttctcatgaccgttactttttagataaagttgctgaaaaattacttatttttgaaggcaacgcgcaaattgttcgcttctatggttcgataaacgaatatttacaaaagacagcaacgaaacagggcacaaagaaaactgcagcctcacaacctgacaaagggctacaaagcaaatttgtttccgaaaagccagtcaaaaagaaactaagctacatggaacaaaaagaatgggcaacgatcgaagatgagattgctctgttagaagaacgagtcgacgcactaactgaagcgatgaatcagcagggggatgactttacgaaattacagcagctccaagcagaagttacagaaacagaacaattgttagaagaaaaaatgacacgctgggaatatttaagcgagttttcagacgactaataaggaggcccattatggaacaagcatatcttgatttagggaaaaaaattttagaaacgggaaatgtcaaaggggatcgcacagggactggaaccaaaagtatttttggtcatcaaatgcgatttgacctctctcaaggatttccattattgacaaccaagcgcgtaccttttggtctgatcaaaagcgagttactctggtttcttaaaggagataccaatattcgattcttactgcaacacaagaatcacatttgggatgaatgggcttttgagcggtatattaaaagtgaggactatacaggtcctgatatgactgattttggccgtcgctcattaattgatgaagaattcaatgccagctatcaagaggaattgcaaaaattttgcgaacgtattttaaatgacgaagcatttgcagaaaaatttggtgatctaggtcatgtttacgggtatcaatggcgtcattgggaaactactaaaggggaatttattgatcagatcaaagaagtgattgaaatgatcaaaacaacgccagattctcggcgcttgattgtttccgcatggaatccagaagatgtgccgtcgatggcgctgcctccttgccataccatgtttcagttttatgttcatgaaggtcgactaagttgtcagctttatcaacgaagtgccgatgtttttttgggggtgcctttcaacattgctagctatgcgttattgactcacttgatcgctcacgagacaggactccaagtcggcgaatttatccatactttaggggatgcccatctgtatagcaatcatatggaacaaatgaaagagcagctttcccgaacaattcgttctgcacctacgttgcacttaaatcctgagaaacaatcgatttttgactttgagatgggagatatcacgattgaaggctacgatccgcatcccacgatcaaggcaccgatcgctgtctaacttattacagttgggagtgagaagatagatgacaaacgatttacagcggggaatcgtcgcaacgctgcatattacgtcaaaagataccatttcattatcagatgtagaaaaaacaattacgatccttcgttcttatttttcgcaagtcattttagcagtttctgaagtaacgaaacctgaaatcaagcggtatttatggcagctgccgccccagatctatctctttgaattgccagcagtcggtgctggtccagcacgtcggcaagctgtggcacgcgctggaaaggcatttccgcaactcgcttcctttcaattatgtgattttgatcgtttgatcacttggtgtgaggaatacccagatgaactgtcagctttgagctgtcagccgtttcctacgaacactttctgtatattaggacgtacaaagaaagccttcctaagccatccaactgcttggcagcggacagaaaagctggtcaatgaaattgcagcggaagtttttcatatcaagggtcttgatattaccgccggcagtgtcttgttttctgcggaattgattcctttactagtatccgcagattcttcaagatggacggatggcgaatggccaaccaaagtgaagcatcatggagggcatattttttatcaagcgtgcgaaggcttgtgttataaagaaagaaataccgatcatctgcaagcacagcctgcttatcaattaatgagaaggctgcagattgcagcggctattgcagattcactttatctagaaagggagttttgaaacatgttgattgcactttgggcacaagacaaaaatggtttgattggagaaaacggcacattgccatggcatttgccaaacgatctgaaattcttcaaagaacaaactactggaaattcgctcattatggggcgaaaaacgtttgagggcatgaagaaaaaagcattgccaaatcgaacaacaatcgttttgaccagtgacacagcatatgaagcagaaggcgtattagttatgcatgatcgacaagaagtcttggattatactgcacagcaagatcatcctgtgtttctaactgggggttctggagttttcgaatcgatgatcgaagattgcgatcagttgtatcgaacagtgatcgacgagacatttaccggagatgtctactttcctgagatcgattggtcaaactggcatttggataaagtcatagaaggcgtagtggatgaaaagaacatctatccgcaccggtttgagttttatagtaagcagaaaaaataaataaggcagctgttacaacatatggttgtagcagctgccttatttaagtaaaagtgggttggatcatgtaaaccaaagaacggaaaaatacattagtccagctccgagcataacaaacaaatgccaaaccacatgcatgaagcgtacggatttgatactgtagaataatgcgccgacggtataagagacaccaccgcttgttaacagaaaggtaccccaaaaacccagtgaagcaatcaatggtttaaatgcaatcacgcagagccagcccataataatataaattagtgtggatatttttgaaaccgtctcttttttatgcagtgtgagtgacttataaacgatcccgctgatggctaacaaccaaatcaaaatgaaaagtgtccagcccaaccaaccttgaatactcagcaagcaaaacggcgtataactgcctgcgatcaataaaaaaatcgaggcgtgatcaaagacttggaaaactttttttgctcgtgtgaacatcaaactatggaagagcgtagagaataagaataacaaaatcatcatagagccataaatcgcataggaaatgatgtgaataggggaatctaatcgagcccctttaatcaaaagaataacgagtccagctatacttaatccaaatccgataccatgggtcaccgcattgagtacctcattcagaatcaagtagcgtcgtgtaaatttcatatgatccatcaagcaccttcccttcgaatttaaataagatgaaaaaattttttctctctgttatactgattataaatggtctatggttattttaccacgaaaagagacttgatttaaagagagagtgaatgtatgatggcaaagcttaaagttgtaacggattcctcctgtacgatggagccaaccgttcgagaccaattgaatatccatgtagttccgttatctgtaatgatcgatgggatggtttatccggatgatgattcattgcccggagaacgattcatgcaaatgatggcacaagcaaaagaacttccaaaaacgagccaaccaccgattggccattttgtggaactgttcgatgaattaggaaaagatggtagtgacgttttatcgatacatatgacgaagggtctgagtggaactgtcgaagctgccagacaagcaagtaatttgtcgaaagcaaatgtgacagtgatcgatagtgatacgacagatcaagcattgtcgttccaagtgattcgggcagctcaattagcacaagaaggtaagacattagctgaagttttgccggaagttgacaaagttcgagaaaataccaaattatttattggtgtctctacattagaaaatctggtaaaaggcggtcgaatcagtcgtgccaaagggttattatccagtttattaaatatgaaagtgattatggatttcgaccattcagaattgattccaatcgtaaaaggacgcggtgtaaaaacatttaataagtggtttgaagaattgaaagacgaattgaaacgcatgccgaatgtgaaacaaatagggatctctcatgcagaggggttagagatcacagaacaattcaaaaaagaattgcaacaactcttcccagaaatgaatattccactacttcataccaccccaatcatcgctacccataccggcaaaggcgcattcgccattacgtattacaccgaataattttaatgacagtatccaagcgattcgtaaacacgaatcgctttttgctgcgaatcacaatgattggcttgcgaagcaagacagaattgatgatgagcagtactaggcgagctgagcgagcgtagtaaccttgaaaagaatcacaaagactggcacacgaagagtgacagagcagatggtgagcaacggcgagccaaacgagcgcgatcttgaaaagaatcacaaagacttgcacacgaagagtgacagagcagatgatgagcaacggcgagccaagcgagcgcgaccttgaaaagaatcattatggttgtcactcgaaaaatgacttttacattctttttaatgtaagtttagaagcaactgcagacgaaacaatgagtacaatgagtagccaagcagttgatgaagcgggactcgaatcaagcagatgggtagaaattgcttcatacttcgctgctcttcgttgattgagtttctcgtcaatcaaaacatttcgactatgaatttaatgagaattttgataaaatagcttagattataggttaggagattgaagatccgtgaagtggaaaaaagtagcaatttatctttcagttgtattgatcgtagctttaggtactggaatgctcggtcattttttgattccaaaagcgcaaccattgctcacaccagttgcgagaacggcagaagagggaaagaccaaaaatgtgatcaattacatggccttaggcgattcgctgactgaaggagtcggtgatgagacgcaacaaggaggatttgtgcccatcgttgcagccgatttgcaagatcggtatcatttagcaaatgttgtgacgacgaactatggaattgctggagagcgcagcgatcaaatcctgaaacgagtgaacaaagacaaagaattgcgcagtgacctaaagaaggctgacttgattacattgaccgtcggcgggaatgatgtattaaaagtgattcaaactaatttttttggtttgagtgtcgattcttttaccaaacccatggccgactatcaagaacgattagtagagatgtttgagcagattcgtcaactgaatgaaacagcacccatttatgtgttagggatatataatcctttttatttaaattttccagaaattactgatatgcaaacgattattgataattggaacaaagcaacagaaacatttgtcaaacaacagcaaaatgcttattttatcccaatcaatgacttgctataccaaggactaagtgacgaagttgggatcgcagatacggattcttctgaagcaggcgcttcaggatcagcagaaacttcggataccacaacttccaccaccaacggtatgaccggtacttcagaaactgggggaacaaaagtgaccaacaatgtactgtatgatggggatcgtttccatccaaacaatctagggtatcagctaatggcgaatgctgttcgtgatgaattaatcaaaacccaaaatgtttggctgatgaaggaggaaaaataatgaaacaagaaactaatgatgtggataaaaaaagtccaatcaaaaaaatgaattactggaaaattgcttttctagttttagtaggcattctgttgggaacaactgtcttttttgcttcacgggtgtttcaacaacgtgaatctgggatctcagaaagtgcagaactagtcaaacgagacggtaatcctgttttgaccatcaacagtaataagagtcaagtcaatcaattgatcgatttctatttaactgattttcagaaagatcaagaagtaaaatacaatttcgagttgagaaatgaggcactactgacaggtcaatttaaagtgctgaactttccaatcacattttacttatactttgatccttatgtcaccgaagaaggcaatgttcagttaaaagccaaaagtttatcaattggtactttagatctgccgaccagtgaagtgttaaaaatgatcaagcgcagcttcaagtttccagagtggatcgaggtcaatgcggatgaacaaattattttgattcgcttggatcaattccgcatgcaaaacggcttgtttatcaaagcgaataaaatcaatctagtagatgatgagatccaaatgagtctctatctgccagcagaaacggaggacaaataatggaacgagcaatttttgcgggagggtgtttctggtgtatgattcagccttttgatgagttagaaggagtacagtccatcttttccgggtatacggctggacacacggttgacccgacctacgaggaagtaaaaagtcataaaaccggtcatacagaggctgttgagatcatttttgatccagaaaaaatcagttttgaggaattattgactatttattggcaacagacggatcccacggatgcttttgggcagtttgaagatcgaggagacaattaccgaccagtcatcttctatttcaatgaggaacaaaaacaaaaagcagaagcaagcaaagccgctttgcaagcatcgggtcgctttaatgccccaatcgtaacgagtatcgaacctgcacaacctttttatttggcagaagaagagcatcaagaatactacaaaaagcatcctgaaaattttgctcgcaatcatgcgagacgagcagcttttcttgaggatcactgggagaatacgcatgcgtaaaagtttttatacttatttaatggccatcaaagggcctagtcatactgatgaggcacagatctttgcgacacatgcaagtcatgatattcaattcccaaaacataccgacgattatgatgaagtttcttcttatttagaattgaacgtcgattatttgccttctatggatatttttgatcgtatttgggaacagtatgtggaggataataaataagagagagtggagtggaaacttcctctctttttacactagaggctaaaaaattaatggacagaaaggtgtctttctatgaaaaatgtttcttttcaccgttatgtgatctcactgatttgtgtcgcgatcctctcgggaggcggtgtctacatttggcaaaaaagtacggctgcaacacaatccccacagaatcagcccacagtggcgacatcaaatgaactggaaaaagttcaaacgctttttgaccaaattcgtgccaattattaccaagaagtagatgaggatgtcttggtcgaaggggcattaaaaggaatgaccgatgcattaggtgatccttatacaacgtatcttagtgaatcagcagccaatgaattggatcagtctttatcaagcagttttgaaggaattggcgccacccttacccttgtcaacgactatccagaagtggcacaagcccctatcaagaactccccagctgagaaaaacggtttgcgtctaaacgatcgtattttgaaagtggatgggaaagaaacgaaaggcctgtcattaacagaggtcgtaaacaacattcgtggcaaaaaagggaccacagtcaagttgacgatccaacgggaaaaagagacctttgacgtatcgattacacgagatacgattccagtggatactgttcatacagaccttgatagtgagaaaaaaatcgggaaaatcgaaattacgacttttggtgaaagtactgcctccgaattaaaagaaggaattgagtcactgagaaagaaaggagcaaaatcatttattctggatgtccggcaaaatcctggtggacttttagatcaagtacagatcatggctagcatgtttttagaagatggaaaaacgatcgttaagtttgcagatgatagtggtgtcataagtgaaacgaaggcaagtgctgctcttgatgaaggattcaaagtcacagaaccggttgtcgtcttggttgatggcggcagtgcatcggccgcagaaatttttgcagctgcgttgcaagaatccgcagatataccagttgttggtacagaaacctttggtaaaggaactgtacaaaatgtaaaagaattaggagacaatagtgagttaaagatgacggtcatgaagtggctgacgccaaatgaagaatgggtcaatgagcaaggtgtaatgccagatcatcaagcagattttcctgagtatgcctatttagctccattaccaagagacaaagaattgaaagaagggcaaagctcagaagcagttgatcggttgaatcagtttctttctgcactaggttatcggaccaccggagatacatttgaccaaaccaccgtatcagccgttcaagccgttcagcaaaaagctgagctggaagtgacagggaaagtgaatgccgaaacagcacaagcaattgagaaagctgtgacggatcaattaaaacaagaagatcatgcttatttgaaagctgtcgagttattatcaaagtagtaacaaagtaaaagaggagggacatcatgcagcgaagaaaaatctggatcgatcgcttttggttcatcattaaatacgcgattattgcattggcctctgcattcctgattcgtgcattcttgctgatccctgtaccggtgggcggaaattcaatggaaggtaccttaagacagggtgatatggttttgatcgagaaaatctcacccatcaagcgatttgatgtcgtcgtttttcaaatgccggatggttccacctatattaagcgagtgattggattgcctggtgaatccattcgttacgaaaatgatcaactatatgttaatgatcagccggtagatgagaatttcctagtgaaaaatcgaaagaatgatcacgaaaatgtctcttatacgaatgactttgatctacagtcattgttgggcgttgaaaagctggggaaagacagctatttcgtgataggtgacaatcgtcgtgcctctaaagacagccgatcatttggtgccatttctggagatgcgattttaggaaatgctcgttttgtttattacccactaacccatatgcgctttatataatgaaaaacaaaaacatcatttattcatatttttgcgtaggtatcgctactttcaaaaaatatgagtagatgatgtttttaatagcagctagtatttttctgcagaaatcaatgttgttggatcctttgcttgataataaaatgctgttcttgtgtcatgttctttacataattatttaacacttactttgttgtttttcgttattctattgaaacgaacaagcaagaaataattttataagtaagcgttgacagtgccattttaagctgatatactttggctgtaagttagaaaaaggaacgagaaatagcgccgcagctgtttcttgagttatgttactgagacgatcaggcagaactcagaatatatatcaagtacactttcttttgtaaagtttatttgatatttattctgagttcttttttctggaaaggagaaacgaatgaaagttaaaaagattatcaataataatgttgccttagtggatagaggagggcatgagtcgatcatctacttaacaggagtcgcattcaagaaaaaagttggccaacatatttctgactctgaagtagaaaagacctttgtcttagatagccaagatcgattagagcattttagctacctcttatctcgcgccgatgatcaattgatcctgcttgtaaacgagctcgtacaatatggagaaaaagaaatcggcaaaagtgccaatgattatctttatttagctttgttagatcatttatcctttgcattgaaacgggcaaaaaaagatcaatatttgaggagtccattgacttgggaggtaaaaaaattctatcccagttattacaaaattgggttagaagccttggaaaggatcaatcaaacctttcaagtcgattttcctgaagatgaagccgttgccattgccttacattttgttaacttgcaggaaacgaaagcaaagtttgatgaacaattagctgatatggaaacgttgcgggatatgctgaatattatcaaatatcattttacgattactttagatgaaaacagcatgaattatatgcgtcttgtgacccatctccagtatttcatcgaacgattgcggaacaaccagacctattccgacaatgagtctcaactttataaacaagtgaaagcaatgtatccggaagcatttgccgcggttgaaaaaattgagatctatgtcaaaggaaagttcaacagttacctgacacaagaagagtacacctacttaatgatccacatcaatcgtgtaacagaaagaggagaatgacatgaatcaataccatgatttcaacgagcaaatcatcaaattagttggcggaaaagccaatattcaagctgttgtgcactgcatgactcgtcttcgttttactttaaaagatcgctcaaaagcagatacaaaaaaattgcaagagctggaaggggttattgatgtggtaagcaataatgttgcttatcaaattatcgtaggaacccatgtaaacgatgtttacaaagatttaattgaccaactgggaatgtcaggagacgaagcagaccagtcaaaaacgaagaaaaatccgatcaaggcgatgctagatgtgatttcggaatcaatgaatcccattttagaaccaatcatctgtgcaggtttattagccgcatttctttcaattatttcattaaccggtttgatttcgacagatagctcaacgtatcaaatttttgatgcattacggtcggctgttttttatttcttacctattttaatggcgatgagctgtgccaaacgattaggcgccagcccttatctagcagtggctttagcagcaaccattttatctgaaccgatcaacaatgtttcaggattgagtttatttggtattgggttaccacagatcacttattcaaatagctttatcccgattttattagcagtatggttcatgggctatgtaacaaagtttgccaaaaaagtcattcctaaaagtttgcagtactttatgtctcctttagtgatcatgctgattactttgccagccacactcctggtttttggtccattagggttttatattggggaaggcatcattggcttcttcaatctattgatggacacgataggtagctggtttgtgatgatgctctattctgcattacagccattcatcattatgttaggcgccggcaatttcattatgcctgttgtggcttcattgattgcagcgaatggatatgatccagcgtttatctcatcatgtacaatctctgacatcgctgtcggcggagcaatgcttggatacttcttgcgtgctcgcaacttgaaacaaaaacaactatttgggaccgtgactttatccgccattttaggagttaccgaaccagccatctatggtgtattcgttaaattccgtcgtccgtttattgctgtgatgatcggtggaggtttagggggactgttcgccggtttaacaggtgtcaaagcttattcaattgcttggggattatttggattacctgcctatattggcgaaggcgacttcatgaatctttggttaatggtggcagcggttgcgatcagttttattggtgcgactatcgcagcctatatgttagggattccagtagaaagtgatgaagtaccggcggttaaagagaaagaacaacctgtatcttctgaaatgattcgttctactgctttaaaaagtgtagtggaaggagaagtggttcctctcaatgaaatcaatgaccaagctttttcaactggtgctttagggaaaggaatcggtatcaaacctataagtcatgtgattcattcgccaatcgatggggaagtgctaacagtctttcctaccaaacacgcgattggtcttcgcagtgaccaaggcgttgaggtcttgatccatattggtatcgacactgtttcgttagaaggcaagtattttacgatgaatgtgaagcaaggtgatcgtgtgaggacaggacaaccaatcggtgaagtagattttgaaaaagttcgtgaagccgggtatgatccaacgactattgtggtcattacgaatacgaatgattttcttgatgtgatcccaacatccaataaccagttggtaaagtcggatgatttactaaatattgtcttgcaatagaaaccgtaataaagaagatagaaaaggtgagcagatgaagttaagaaatgattttttatggggcggcagcattgccgctcatcaatgtgaaggtgcttggcaggaagatggcaaaggcccagctattatggactatgtcacagtaggcagctatgaacagcctcgtgagatcgataaagaacttcttgctaacaaggtttatccttctcatacaggcatcgatttttatcatcgttatcaagaagatattgctttgtttgcagaaatgggattcaaggcattacggatttctattgattggtcaagaatttatcctaaaggggacgaagcagaaccaaatcaagccggtatcgatttttatcagcgagtcgttgacacgctattaaaacatggtatcgaaccgatcattacgctctatcacttcgaaatgccgattcatctagtgacagaatatggttcatggacaaatcgcaaagtcgttgatttctatttgcgcttttgtcacacgatgtttgaagcattcaaaggaaaagtcagatactgggccacttttaatgagatgaaccatatcgattctcaaagtgaggctagtgatatctttacctatatcattgccggattaaagtactctgaaatcgatgctaaggcccagacattagccatgattggctacaatatgacgcttgcaagttgtgctgctgtcaaaatgggacatgaaattgatgaaaacttccaaattggctgtgtttttggtatcgagccagtctatccagcaaattgtgatcccgtcaatgttctaaatgcctataaacaaatggatcgtgacttctatcagatcgatgcaatgtgcaatggtctgtttccccaatacaaactggaagaatatgcagatcaaggcataaaaatcgtgatctctgagtcagataaaaaagtgtttgctgagggcaaaattgattttattggcatgaattactatgcgtcttctgtcgcagaatatgaaggtgcatcggaaggaaaaagtgctttatttggcggtctgcaaaatccttatttggaaagcagtaagtggggatggacgattgatccgattggcatgcggtatttgttaaattacacttatcgaaaatacggattaccaatcatgattactgaaaacggactaggtgcagtggatgaaatcgcagaagatgggcatgttcacgatgcgtatcgcattgattacttgcacagacatgtcgagcaattgttgctgtcagttgaagaggatcaggtagactgtatcggttatctaacgtgggcgccgatcgatttagtcagtgctacgacaggtgagatgaaaaaacgctatggatttatctatgtcgacaaacaagatgatggaacagggtcttatatgcgtaagaaaaaagattcctttgagtggtatcggcaagtcattaactccaacggtgagagtatcaaaagggagaatcatgagtaaaaattagttttctattcatttcatttgtattttttttcatcaaaacttgtatcgatacgcactttaataagaaatgatggcgatctagaaagaagtaaattctttctagatttttttgttttcattgttttcataaatcagtatgagcgatgggaacctcttggtttcaaaaaggtttgatcttttcgattttgttgatcttagtacttagctacgatacatagctgcatttcgttttatttctattacttatatattcaaacgaggtagccgcttgcttgagcaaatgtgaaaaaaatgttctagaaataacgataaaattttttacagtgttgtaattctgtcagacttttggcattttttcttcaaaattgataagatgatttgagtaaaagacgtaaaatgaagtataattttaactaggctgaaaattggtctttttctcaaaaaaagttggcttcctacatcctgacactcagctagctacttttagctactttttcctaattttagctactttcacaagccagcaagttctcttggactgacactgagtgacagaatgaattgagccgtggaccaactcccctcatggtatttttaaattagtctgccaagtgattctagtgaatgaattaacaaggaaaggctgtggaatcagccaaataatggcatataacagaatagtcagcgtagttgggcagtttttggccattctttggatatttgctggactgtaagagcaggttgaatgagcaaatcaccactacaatacgcgtctcataggtatagttgcaggtgattggcaggtagtatttccaattaaaccaattcgtgttaaaatgcgtaggatactcggcaatcaggaaattttctcgattcgtccgatacttttaagagaaagccaaaacaatgtctgaaaaagactggtatgaaaggaaattaattatgagtaccattcaatggtttccaggccacatggccaaagcaaaacgtgaagtaagcgaaaaactaaaatttgtcgacatcgtgtttgaacttgtagatgctcgtctccccgtttcttcaagaaaccccatgctggatcaaattttacaacaaaagccacgcttgatcttgatcaataaagcagacttggctgaccctcagcaaacaaaactctgggaaggctattttagaaaacaaggtttcttagccatggcgatcaatgctcaggatagtcaaggaatcaaaatgatcgttcctaaagcaaaggaagttctgcaagaaaaaattgctcgtgacaaagctcgtgggctcaaaccacgtccgataagagcaatggtcattgggattcctaatgtaggaaaatcaacattgatgaatcgcttagtcggcaaaaaaattgctcagactgggaataaaccaggtgttaccaaagggcaacaatggttgcgttttggtacagaattggaattgctggatacaccaggaattctctggcctaaatttgaagatcctgagattggcaaaaaattagctttgactggcgctatcaaagatcaactcatccatttagatgatattgctttgtttgggttagacttttttgctcgctactatgaaggaagaattgctcagcgttattcactttctgcggaagaagaacaatgtctagcaccagaactattgatgaagatcactgaaaaacgtggctacaaagacaattatgatcgcggtagtgaattagtcgtttttgatattcgacaagggaagctgggaaggtacacattagatcgttacgaggagttaggtgaaaaagatgaaagagccgattaaaactatcaaagagcgactatttgccgaggaggttgatccggcttatgtggctcaactgatggcagacgaacgctctggtgtccaaaagctgattaccaagtatcaaaatcagcagcgtaaacagcgacaaatgcaagaaaaatatgcagaaatgtctgtatttgaacaagaactctatcagaaagggcttcggtttgttgccggtttagatgaagtcggccggggaccgttagctgggcctgtagttgccgcggcagtggttttaccgaagaattgcgggatcattggcttgaatgattcgaaacaactttctgcgaaaaaaagagaagaattatttattgagatccaaaataaagcggtagcgattggcatcggtattgcagatcatgaggaaattgatcgtgtgaacatttatcaagccagtaagaatgcgatgaaacgagcgctagctgacttatcgattacaccagagcatttattggtggacgctatgacgcttgataccgatattcctcagaccagtctgatcaaaggggatgcgcggtcgatcactatcgctgctgcaagtatcatggctaaggtatttcgggataatttaatgaaagattatcatggtgtttttcctcattatggatttgatcaaaatgctggttacggtacgaaaacccatttagaaggattagctgcccatgggatttgtcctatccatcgcaaaacgtttgcaccagtaaaacagtatgtaaaataattcatcaaacagcctcatttttacgaatcttattagtgagattctttagaaatgaggttgttttatgtactatcaggaatgtacgcccttcgataaaatcctccttcgcttgtcatttgtacaaggagtcggtattcaaagtcagtggcaggtggtcaaaggctgcctcgcacaagaaaattggactataacggctgaagaagttattcaaatgacagggatcacacgcaatattcttcgttttcaacagtcgtggcatcagttgacagagagtgacttagcggaaaaaatggccgaccagtcatttatcacctttttttcaaaagactacccacctgcactgagaaaaatcgctgatccaccattgatcctcttttacgaaggaaatctgtcattactccaaaagccttcactggctgttgtcggtgctagacaagcgacaagctacggtcagcagatttgtagaaaaatcattccggaactagtgaaaaagaagtacttgatcattagcggccttgcccagggattagatagtttcgcccatgaagcagcgattgaaagtggtggacaaaccattgcagttataggaacgggactggatcagtgttatcctaagagttcgcaacgtctttattctcagatcaagcaggaacatttgctggttagtgaatattcgcgaggaacattgccgcataaacatcattttcccatgcggaatcgactgattgcgggaatcgcacaggcagtttgtgtgattgaagccaaagaaaagagtggctctttgattactgcacagttggctttagaaaatgggaaggatgtatttgccgtgcctggagaagctttgaccgatcgatcagaggggtgtcatcagttgattcaagatggagcaaaatgcacgctgacagcagaagatatcttagaagaattgccttaggcttttgaacttatgatgatcctttcttgacaaaactttttctgaaagctatgataagctacgatttggatgtttggaaagcaagtggattgtttgccgaatatattatagtaggaaaaaatgaaggaaggagccattttttatatggcatataaatatctagtgatcgtggagtcgccagcaaaggcgaaaaccattgaaaaatacctcgggcgcaactataaagttgttgcgagtgttggacatattcgtgatttgccgaaaagcaaaatgggcattgacgtcgaaaatgactatgaacctcattacatctcgattcgcggcaaaggcgatgtcatcaagagccttcgttctgcagctaaaaaagcagaaaaagtttatctcgcaagtgacccggatagagaaggggaagctattgcttggcatttagctttcttgctaggactagatttaaaagaaaagaaccgggtcgtttttaatgaaatcacaaaagatgcagttaaagctgcgttcaaagaacctcgtacgattgatgtcgatttagtagatgcgcagcaagctcgtcgggtattggaccgtctggtaggttattcaattagtccaattttatggcgcaaagtcaaaaaaggattgagtgcgggccgtgttcagtcagtagcattgaaaatcatcattgatcgcgaaaaagaaatccgcgagtttatacctgaagaatactggagtatcgatggcaactttaaaaaagcaacaaaaaagttcaaggcgactttctgggggctagatggtaaaaagaaaaaactaccaaacgctgaaagcatcaaagaagtgaccgatcgtttagatggcaaagattaccaagtgaccaaggtagaaaagaaagaacgaaagcgcaatccttcggctccttttacaaccagtagtcttcaacaagaggcagcccgcaaactgaatttccgtacacgtaaaacaatgatggtagcccaacagctttatgaaggaatcccattaggcaagcaaggaacggtggggttgatcacctatatgcgtaccgattctacacggatcgcggatacagctaaaggagaagcggcggaattcatcgaaacaacctatggctcagctttttcagctcatggtggcaagaaaatcaagaatgcgcaaggggcgcaagatgcccacgaggctgtacgtcctacaagcgtcatgcgtacaccagaagaaatggaaaagtacttggacaaagatcagttgaaactctatcgcttgatttggtctcgttttgtagccagccaaatgacccctgcgattttggatacaatgaaagtgacgctacagcagaatggcgtcatattcatagctaacggatccaaaatcaaatttaaaggattcatgcaagtgtatgttgagggacgagatgacggcaaagaagacaaagagaatattttgccggaattaaacgaaggggacgttgttcagtcgatctctatcgaaccaaaacaacacttcacacaaccacctgctcgttttagcgaagcaacgttgatcaaaactttagaagaaaatggtgtagggcgtccatcgacttatgcaccaactttagaaacgatccagcggcgctattacgttaaattaactcaaaaacgttttgaaccaactgaattgggagaaatcgttaattcgttgattgaggaattcttccctcaaatcgtcgatacccatttcacagccgagatggaaagcagcttagacagtattgaagcgggcaaacaagaatggatcaaagtcgtggaccaattctatcgaccatttgaaaaagaattatccaatgcggaagaaaatattgagaaaatccagataaaagatgaacccgctggcttcgattgcgatatttgcggtcatccaatggtcatcaagctaggtcgttatggaaaattttatgcttgtagcaattttccagattgtcgaaatacaaaaccgatcgtcaaagaaatcggagtggaatgtccagtttgtcaccaaggacaagttgttgaaagaaaatccaagaagaaccgaattttctttggctgcacacgctatccagaatgtgactttacgtcatgggataaaccagtaggcagaaactgtccaaaatgtgacaactatttggttgaaaagaaagtcaaaggcggcaagcaagtcgtttgtatcaaaggtgattatgaggaagatgttcaaaagtaggctatcgatcgtttttgacctctcaataaaaaaatgaagtgagcgcaagaagtatctgctgagagacagcagacttctgcgttccttttcaaaaaacagagctgtgacacaaggaatagaataaaaaatatgcagagacaaacggtgatctgaagatcagcatctgccaatgtaagggttattttttgttttgatgacttttggcacagactcttttactataaaggagacgaagtatgaaaaaaatcaatgtaattggtgctggattagcaggaagcgaagctgcttggcaagctgctgaggcaggagtggctgtcaatttgtatgaaatgcgtcctaagaaaacgacagaagcccatcatacgaataattttgcggaacttgtttgtacaaattctcttagaggaaacaatttaaccaatgcagtaggtgttttgaaagaagaaatgcgccgcttgaattcggttattatctcttcggccgatcagacagcggttccggctggtggtgcactagccgttgatcgggacgatttttctgaattagttacaaagcgggtgaaagaacatccgttggtaacagtgatcgaagaagagatcaccgaaatcccagaaggaattacggtaatcgctactggaccattgacttcagaaccgttatccaaggcgattcaagcattcaatgggtcggaaggcttctatttctatgatgccgcagcgccaatcattgataaatcaactattgatatggataaagtttacttgaaatcgcgatacgacaaaggagaagcagcatacctgaattgtccgatgaacgaagaagaattttatgcctttcgtgaagccttggtaaatgccgaagtcgctcctttgaaagagtttgaaaaagagaaattctttgaaggctgtatgccaattgaagtgatggcctctcgtggtccaaagacgatgttgtttggaccaatgaaacctgttggtttggaagatcctaagacaggcaaacggccttatgcagtgatccaattgcgtcaagataacgctgctgcctcgttgtacaacattgtaggtttccaaacgcatctaaaatggggagaacaaaaacgggtctttcggatgatccctggattagagcaagctgaatttgtccgctatggtgtaatgcatcggaatagtttcatgaactcgccagaacttctgcaacaaacctatcaatctcgcaaacgtgatgacttgttttttgctggtcaaatgacaggagtagaagggtatgttgaaagtgcggctagcggtctagtagctggaatcaatgcagcaaaacttgcaaaaggggaagaaccaatcatctttccgcaggaaacaacaatcggcagcatggcgtattacattacgcatgcagaaggcaaacatttccaaccaatgaatgccaattttggcttgcttcctgaactgcccgaacgaatcaaagataaaaaatcccgttatgaggcattggctaatcgtgcgcttacagctttagaggctgccaaagaaacagttgcaaattaattgtcgaaaactttctcacgagaaattgttgagaaagttttttttgaattgtcttgaaacttggtagcggttatcatatgattaacagtaacaatagcgaaggtggtgacgatcgtgattggggaatgggtcacattgcttcaagagtatctgcagcagtttccatcttatattcaaatagtgggctggctgattgtactatttgttttgatatttgccgtttttctgcttttcagtttgttgctaggcccgtttatgtggcttttcaatcgcttgacagataaaaatcgtagcaatgttcttggtcatgaagattttttgattggtgaattgacagaaaagatcgtcggaaataccctcggtgaagtgatggagattggcagtaagacagcgcgttctgtttatccggcaaagttctataaagaagaggatattcgagaaaagcgagaattaccagtcggaaccaaagtgattattgttgattttgacaaaaaaggtattgctttagtggtagaaaaccacaattttattgaatagggagtgttggaaaatgttagatacagggaatgcattagattttttaagtaatccaattttatggatcatcgttttagtcgtgttattgatcgcatttttaatgattcgttaccgaatcggcaagccagatgaagcgttgatcgtaacggggtcatttttaggtaaagaaggcatcaagattttaaaaaatagcggaacattcgtgatcccaattgttcaaaaagcacataaattgagtttactgacgcataaacttgaaattggcacaccagaagtttataccgaacaaggggtaccgatcaaagcaagtgcgacggttttagttaaagttggtaacagtacggaatcgatcaaaacagctgcagaacaatacttaggcaaatcaaccggcgagttggaagatgaagcacaagaagtactggaaggccacttgcgggcgattctagggacaatgaccgttgaagcaatttacaaaaatcgagatgattttgcggaacaagtgcaagaagtcgcatctaccgacttgaaaaaaatgggattagagatcgtttcatttacaatcaaagatgttagtgacagtaacggctacttagatgccttaggacgaccgcagattgctgaagtgaagaagaatgcagaagttgcagaatcaaatgcattaagagaaacacgaatcaagcaagccgaaaatgaacagttggcacagcacgaggaaattcgtcgccaaacggaaatcgcagaagcaacgaaagatatggcattgaaacaagcacaatacaaacaagaacgggaagtagcagatgctaaagcagaacagattgctgtgggcgaaaaaatgaaagtccaattgatcgaacaagaaaagaacatcgagatccaagaaaagcaagctgaactgacggaaaaagaattgaatgctacagtccgtaaaaaagcagaagccgataaatatgttgtagaacaaaatgccttggcagataaagcaagagaaattgctcgtgcccaagcagaggctgaaaaagtgaaactagctgcccaagcagaagcagagagaatcgaaaaactcggttcggcagatgctgaaagaatcgctaaagtcggtcaagcagaagccgaaagtcgcgaaaaaatggcgattgctttaactaaactgaatgaagcaggtattttgatggaattcatcaaagtattacctgaaattgccaaagaagttaatgcgccacttagcaacatcgataaagtggtcagctttggaggcaacgacggactccacgacatgggagaagccggcttggcacggacatttgatactatcaaagaaacaactggcctcgatttagtcaatctcattaatcaaaccatgtctactaaacaaggaaacaaagagttagtagcagccatcgaaagccaaaagccagtagaaaatcaatcaaacacagacaatgacacccaaccaatcgaataacccaaacaacgcactcaaacgagtgcgtttttgctgcgaatcacaacgagtggcttgcgaagcaaggcagagttgatgatgagcagcggggagcaaagcgagggtagcaaccttgaaagaattttctacggctgactctggaaagagtggaacgcaagttctacttagttcacagtgagaagctactggaggcaaagcatatgccaagttgaatttggggcaagtccttcgcaagttttcgtgtaaatcataacaatcaaaaaaagcttcgagaaacctgcggatcttttctaaattctcccttaaagaattttcataattatgtctaaactttgaaatattggttaaattctgacaattcgtttgttttttttaaaactctatgatacagttatttcgagtcatgaaatgggggattagtttgccggagaacgaacttcaaaatgatttttttcgttatctaattgttgaacgaggctattctgataagaccaagtctgcttaccaagaagacatggaggatttctttcgttttttaaaagagtctggcaatgaagactttcttgccattgatcaccgtgacgtcagagtataccttagttttttgaatgagcgcaattacagtcgcaattcgatcagccgtaaaatggccagtttgcggtcgttctatcactttttaacgaaacacgaagtcattaaagaaaatccattcgcttatattcacttaaagaaaaagaacgcaaaattaccgcgttttttttatgaaaaagaaatggaagcactttttgaaagtgtaaaagggcacgaacctttgcagcaacgaaatcgagctttgttggagatcctgtatggatccggactgcgggtcagcgaatgcagcaacctaaccttgtcagacgttgattgggagaatggtgtattgttgatccatgggaaaggaaacaaggatcgttatgttccttttggcagctatgcgcaagaagcgttgcgagactatgtctcagctggacgccaacagttgatggagaaacaccacaaacggcatgagattgttttcgtcaatcatttaggtgacggaatcacagcgacggggattgagtatgtgttgaatcaaatcattcgcaaaagtagtttggacagcaagatccacccccacatgttgaggcacacatttgccactcacttattaaatcacggggctgatatgcggaccgttcaagaattgttaggccatgccaacttatctacgacgcagatctatgcccatgtcacaaaagatagcttgcaaaaaaattaccgccaatttcatccaagagcttaaaaattggcgacaggaggaaagaattatgaaatcaccttttcattcaacaacgatttgtgctgttgaaaaagatggcaaattcgcaatggccggagatggtcaagtaacaatgggagaacaagtcgtcatgaaggggacggcacgcaaagtacgccgaatctataacggtgaagtcgtagttggatttgctggaagtgtggcagatgctttcacactggaagaaaaatttgaaggaaaactcaatgaatacaacggcaacttacaacgtgctgctgttgagttagcgcaagaatggcggacacagcaatcgatgcagaaactagaagcaatgctgatcgtgatgaatcaggaagaaatgctcttggtttctgggacaggagaagtcatttcaccagatgaagggattttggctatcggttctggcggcaattatgcactcgctgcagccagagcgatgaaacgttacggcggtgatctttctgcaaaagaaattgctgaaggagcattgaatatcgccgctgatatttgtgtctttaccaatcacaacattattgttgaagagttttaaagagggatgaagctatgacaaatcaaaatatatcaccaaaagaaatcgtcaaagaattagatcaatacattgttggccaaactagtgccaagaaatctgttgcagtagctttacgtaatcgctaccgtcgtctccagttggatgagaaaatgcagcaagatgtgacgccgaagaatattttaatgatcggaccgactggtgtcggaaaaacagaaattgctcgtcgattagcgaagatcgttgatgcgcctttcgttaaattagaagcaactaagttcaccgaagtcggttatgtcggacgtgacgtggaatcaatgattcgggatcttgtggaaaatgccatccagatcgtaaaaaaagagcaatacaaaaacgttcggctgcaggcagaaaagaaagccaatcgtcgactggttaaagtactggtacctggaatcaaaaaagagcaaaagaaatctgcgaatccatatgaacaaatgatgaatatgttcaatcctggccagcaggcagaagaaccaaaagaagaactgacggacgaaatccgcagcaaccgtcaagccatttatgagcaattagaaaaaggcttattggacaatcgtgaagtaacgatccaggtggatgaaccaaaaacacaggcaccaatgatgaacaatggattggaacaaatggggatcgatttgaatgaaacattaggtgcattgaaaccgcaaaagaaaatcgaacggacagtaacggtaaaagaagctcgagaattattgatccaagaggaatcttcaaaattagtgaatgatgcggatatccatagtgcggcattgcgtttagccgaatctagcgggatcatcttccttgatgaaatcgataagatcacatcaaaatcgcaacaatcaggcgaagtttctcgtgaaggtgtgcaacgggatattttaccgatcgtagaaggatcacaagtcaacacgaaatacggccctttacaaaccgaccatatcctattcattgcttcaggtgcctttcatttgtcaaaaccaagtgatttgatccctgaattacaaggacgcttcccgattcgtgtagaacttgatgatttaacgaaagaagactttgtcaagatcctgacggagccaaacaatgctttgatcaagcagtatattgccttgttgggaacagagaatgtgacagtcacttttacgctggaagcaatccaaaaaattgcggaaattgcctttcaagtgaatcgcgatacagataacattggcgcccgtcgcttacacacaattctagaaaagttacttgaagacttattgtttgaagcatccgacatgcaaatgggagaaatcactattacagaagcgtacgttgaagacaaacttgcttctattgccaaagatgaagacctaagccggtatattttataaagggagagaaccaatgaaaacacttttagaaaagacacgacaaatcaatgaattactgcaacaaaaaaataccttcaatctggcatctgatttgccttatgataaaatggcggttattttaggtgacatactcgatagcaatgcttatattatcagtagtgacggtagtgtgttgggattcgttgagacgcatgatgtcaacaatgaacgtatcaaaaagatgtttgtagaaaaacagtttcctaaaaattatacaagtttagtagataatttatcttcgacagaagcaaatgttcccatcagcaacgatatgactgcttttcctattgagatgcgggagttatatccgaatggtttaacaacaatcgtgcccatttatggtgcaggcgaacggttgggcacgatcattttgtctcggatcgaaaaaacgttcgatgacgatgatctagtcttagcagaatacagtgcaactgtagttggcatgcagtttctttatcaaaaatcccgcaatatcgaagaagacgttcgtagtgcgactgccgtacaaatggcgatcaatacactgtcatacagcgaattgaaagctgtccaagcgatttttgaagcattagaaggggatgaaggacgtttgaccgcttctagtattgcggatcgaatcggtattacacgttctgttattgtaaatgcattgcgcaaactggaatcagcaggtattattgagtcacgttccttgggaatgaaaggaacttatttaaaagtgttgaatagtcgtttcaaagaggaattgaacaaacatcaatattaggagatggcgatatgacagttacgatcagcgcagggcatttgcaggcaacaattgccgaaaaaggagccgaactgcaaagtttgattgatgtgaataccaacttagaatatatttggcaagctgatcctgcacattggggaaagcatgcaccaatcttatttccgatagtgggtgcgttgaaggacaatcaataccgctacaaaggtgaaacgtatcatctgccacggcatggttttgctcgagacatgatgtttgaagtcgtggagcacaaagtagattatgttcgtttactactagctagcagtgaggagacaaagagcaactatccctttgattttcagttgtttgttagttacgaattaggtggagacggtcttgtagtcaagtatcaagtcgtaaatgatagtcaggaagacatgttcttctctatcggtggtcatcctgcattcaatgtaccgttaggagaggataatgtatttgaagatttttatctcacattctcacctaagaaatctcgtgtaaaattgccgttggtaggcaattatatcgatctggagcagcggacattgggacaaacgaacactgatctacggttgactcatgagatgtttaagaacgatgccttgatttatgaaacgaaagggttgaattcattttcgatccgcagtgaaaaatctcctcacagtgtgacattgagctataataatatgccttacgttggcttttggacgacttatccagtagaatctccttttttatgtattgagccatgggtaggtattgcagataccttagagactagtggcgaactacatgaaaaaacaggaatccaatgcttggcagccaacgagcaatttgaaacgaaatattcgatcacagttaagtaagcctatgtgaataagaaaaaaagaagctgggacgaaagtcatgaatgacttttcccagcttctcctattcttttttattaagaccaaaagagatacggctctctgtgccgtctttgatccgcttgatattttcacgatgacggataaaaataaaacaggtgacaccaattgcgatacacgtcaataaccaattttgttttggtaaaatcattggtgcgacataaggcaataggattgtcgacaaagtgatcaagcaggctgcaatcatacttgtcaggctgaccatgctggttatgaacaaacaaaccacaaaaataagcgctgaataaatgaagaaaattggattgtagcctaaaagcatgcctgcgctggtcgccaccgctttcccgcctttgaacttggcaaaaattggaaacgtgtgacctagaatagcacaaacaccaaaccaaagaggattgattgttgtgactgaaaagatcgccggcaaacaagtagccaaggtacctttcagaatatccatcaataaaacaatgacgccagctgatttgccaagaacacgaaaggtattcgtagttcctgtattcccgctgccaaattggcgaatgtcttttttgaagaatagctgaccgatccagacaccagagggaatcgaaccgagcaaataagcaataaatagtaacagaatcgtcttcatgataacccactttccttgaaagtctagagcaattttagcatgaaaccgtcgcagcaacaataagaaaatactgaagctatggataaacgagcaatgatagatggatcatccaaaagctaaaagtgactttgccttgtcgaacggtaggaaaaaggataagatagtttagaaaaatgttcgcttgaaaaaagccgattttatgttaagattttttttgcgaatcattcatgttgggtttccgcggaaacccacttaatttagttaaaggagcggtggctttggcaaagaaaaccacagagtataatgatgcctcgatacaagtcctagaaggcttggaggcagtgagaaagcgacctggtatgtatatcggatcgactgacggccgaggcttgcaccatttggtctacgaaatcgttgataatgcggtcgacgaagcactatcaggattcgggaatgaaattgatgtcactatccacaaagacaatagtatcagtgtgcgagacaatggtcgtggaatgccggtaggaatgcatgcttcaggaatcccaacagtcgaagtcatctttactgtactgcatgctggcggcaaatttggccaagggggctataagacatcaggtggactccacggagtgggtgccagtgttgtaaatgcgctatcaagctggctagaagtttctatcgtacgagatggtatcgaataccaagagaaattcaaagatggtggcaaacctgacggtacattgaaaaaaatcggaaagacgcggaaagcaactggaacaaccgtacgtttcaagccggatgacacgatttttacaacaacgaaattttcttatgacacgttagcagaacgattgcgagaatcagctttcttattaagaggagtgaaaatcaccctaacagatgagcgggctgaattgcagcaagaggtctttttatttgaagaaggaatcaaagagtttgttgattatttaaacgaagaaaaagatacattgacgcctgttgtgtatttttctggcacaaaagaagcaatcgaagtggaagttgctttccaatataatgatgggtattccgaaaatgtcctatcatttgtaaataacgtgcgcacgaaagacggcggtacccatgaagtgggaatgaagatctctatgactaaagctttcaatgaatatgctcgaaaggtcggcctgctgaaagaaaaggataaaaatctggaaggcagtgattttcgggaaggtttagcggcagttctgtcgattcgggtaccagagaatctgcttcaatttgaaggtcaaacaaaagaaaaactaggaacgccgatcgcacgaaatgcggtagacaatgtgattggtgaacaactgggttattacttgcaagaaaatagcgagatgagccaaatgcttgtccgtaaagccatcaaggctcgggaagcgcgggaagctgctcggaaagcacgagaagaaagccgcagtgggaaaaaacgcaaaaagggcgaatcgttgttatctggaaaattgacaccagcccagtctcgtaatccgaaaaaaaatgagttgtacttagtcgaaggagactcggctggtggatcagccaaacaaggccgagaccgtaagtttcaagcaattcttccgttacgtggaaaagtcatcaataccgagaaagccaaaatgcaagacattttgaaaaatgaagaaatcaatactatgatctacacgatcggcgcaggtgttggtccagaattttcgattgaagactgcaattatgacaaagtaatcatcatgaccgatgcggatacagatggtgcccatatccaagtcttgttgctgaccttcttttatcgctatatgaaaccattgatcgaagctggcaaagtttatattgcattgccgcctttgtacaaagtttcaaaaggcctaggcaaaaaagccgtagttgaatatgcctggacagatgacgaattaaacgcggtgaccaaaaaaattggtaaaggctatatgctgcaacggtacaaagggttaggtgagatgaatgcagatcaactttgggagacaacgatggacccagaaacaagaacattgatccgtgttcgaatcgatgatgcggcacaagcggaacgacgggttactacattgatgggtgataaagtagaaccgcggcggaagtggatcgaaagccatgtccaattcagcttggaagaagacggcagtattttagagaaaaaagaagagacgatccctggattggtcgaagaaaaattacaagaagctgagcaaatttcagcaatcagcttgtctgaggattaggaggggatctcttggaacataaaaacaatatacaagaattaacattagaagaagtgatgggggaccgtttcggcagatactctaaatatattatccaagaacgggcattaccggatattcgagatggcctaaagcccgttcagcgacgaattttgtttgccatgaatcaagatggaaatacttatgacaaaggatttcgtaagtccgcaaaatctgtagggaatatcatggggaattttcatccccatggagattccagtatttatgaagccatggtccgtatgagtcaagactggaaattaagacaaatcctgatcgaaatgcacgggaataacgggagtatggatggtgatccgccagcagctatgcgttatacagaagcccgtttgtctgaattaagcggagaattattgaaggatattgaaaaagataccgttgagttagtttggaattttgacgataccgaaaaggaaccaactgttttgccagcaaaatatcccaatctgctggtcaacgggtcgacagggatctctgccggttatgcaactgaaattcccacacacaatttaagtgaagtcattgacggaacgatttatttgattgatcacccgaacgcctcattggataaattgatggaattcattccaggtccagatttcccaactggcggcatcttacaaggaaaagaagaaatcaagaaggcatatgaaacaggtcgtgggaaagtgatcttacgttcaaagactagaatcgaagatatcaaaggcggcaaacagcaaattgtcatcaatgagattccttacgaagtcaataaagcgaatctggtcaaaaaaatggatgagattcgtttaaacaaaaaaatcgatgggattgccgaggtccgggacgaaacggaccgtaccggtttgcaaattgtggttgagctgaaaaaagatgccaatgctcaaggaattttgaactatctatttaaaaatacggaactgcaaatcaactacaatttcaacatggtagccatcgatgaaatgcggccgcagcaagtcgggttgaaacatatcttagaaagttatgtgaaacaccgtcgggaagtcattgctaagcggagccgctatgagctgaagaaagcgcagaaacgtcagcacatcgttgatgggttgatgaaggctctttcgatcctcgatgaagtgatcgcgacaatccgcagcagtaaagacaaaaaagatgcaaaaaataatctggtcgttcagcatgggtttacagaagaacaggcagaagccattgtaacattgcaattgtatcgcttgactaatacagatatcacgcaattacaggcagaagcccaagaattagctgaaacgattcgcgaattgacgaaaattttgaatgaagaaacggaattattaaaagtcatcaaaaaagagctaagagaaatcaagaagaaataccactctgatcggatgaccgagattgaagcagagatccaagaaatcaaaatcgagacccaagtacttgtcgcccaagaagatgttgtggtaactgttacgacagatggctatgtcaaacgcagcagcttgcggtcttatggcgcttctaagccagaagagttaggcatgaaagaaggcgatgcactgctttatagcgggcaagcaagcacattggatcatttgttgctggtgaccaataaagggaacgtcatttatcgccccattcatgagttgccggatctcaaatggaaagatctaggggaacatatttcgcaaacggtaatgaatctagcgaccgaagaaaccattttagctgtattcacctatcaagaacttgatccgcaaaagaatttcgtgctgattagcaaaaacggtatgattaaacaaacaagaatgacagaatttgaaccttggcgtacgtacaagagtcggccattgactatgatgaaactaaaagatgaggccgatgaacttgtcaacgtgtatttagcggatcaaaatgagccgttggatgtctttctagttagttatcgtgcttttggcctacgctatccattagccgaagtgcctgttgtaggaccaaaagctgctggagtcaaagcgatgaatcttaaagaagatgatcagatcgtcaatggattattggtttactcggaaggagatacgcctgtaatcatggtcactcagcgaggggcggtcaaacgaatgctggctcaagaaatcagtcagttaggacgagcgaaacgaggactgatggttctcagagagttaaagaaaaatcctcatcggattgtttatatgggaagcggtgaaaaccaatccctgattttgactactcaaaaggggcaaatgatcgagatcgagacgaatcaaatcccaatcaatgaccggacatcgaatgggtcctttgttaccgatgaaaaatccggcggcttgatccatgaagttgctcgagtgattgatcctgcgattcaagaagattctgtactataagttaaatgtaaaacacgcatctgtaccaatacagacgcgtgtttttttctatataattaatttttcacattttcaaaaaatggactttaataaaaaattcacatttaaaaaacgttgatttaaaagctgtttcgttgcgttttatgttttaatagctaattttgttaaaaataattcttgtaaatgcttgcaatgcaaacgctttgtgttatactattcacgtaaagctgttacacttagtgaacagaaaatttaaggaggtccatcaaatggaacaatggaatggatttaaaggaaaaacttggaaagaagaagttaacgtacgcgacttcatccaagaaaactacacaccttatgacggaacagacgaatttttagctggcccaactgaagcaactacaaagctttgggatcaagttatggacttgaacaagcaagaacgtgacgctggcggcgttttagacatggatactaaaatcgtttcaacgattacttctcacggcccgggctatttgaacaaagagttagaaacagttgtcgggttccaaacagacaaacctttcaaacgcagcttgcaaccgttcggcggtatccgaatgtcagaacaatcagcagaatcttatgggtatgaaattgattctgaagtttctcacatcttccgtgactaccgtaaaacacacaaccaaggtgtatttgatgcgtacactcctgaaatcagagctgcacgccgttctggtgttatcactggacttcctgatgcttatggtcgtggtcgtatcatcggtgactaccgtcgcgtagcattgtatggtgtggattacttgatcaaagaaaaacaacaagacttgttgtattgcggcaatggcacgatgtcagacgatatcattcgccaacgtgaagaattaagtgaacaaattcgcgcattaagcgaattgaaagaacttggtacaatctacgggtttgatatttctcaacctgcacaaactgcaagagaagcattccaatggttatatttaggctatctagcagccatcaaagaacaaaacggagcagcaatgtctctaggacgtacgtcaactttcttggatatctatgtagaacgcgaccttaaaaatggcgtgatcacagaagaagaagcacaagaaatcgttgaccatttcgtaatgaaacttcgtctagtgaaatttgctcgtacacctgaatacaatgcattattctctggtgacccaacatgggttacagaatcaatcgccgggatgggtgaagacggacgccacatggtaactaaaaacagcttccgtttcttgcacacactagcaaacttgggaccagctccagaaccaaacttgactgttttgtggtcaacacgcttgccacacaacttcaaaacattctgtgcgaaaatgtctatccaaacatcagcaatccaatatgaaaacgatgatgtaatgcgtggacattggggcgatgactatggaatcgcatgttgtgtatctgctatgcgcattggtaaacaaatgcaattcttcggtgctcgtgcgaacttggcgaaaacgttgttgtatgcaatcaatggcggggtcgacgaaaaatcaaaagcgcaagtgggacctaaattccaaccaatcacttcagaatatcttgattacaatgaagtaatggaaaaatatgacacaatgatggactggatttgtgatttgtatgtcaatacattgaacattatccactacatgcatgataaatattcttatgaacgaattgaaatggccttacaagatacagatatcttgcgtacgatggctactggtatcgcaggattctctgtagcagttgactcattatctgctatcaaatatgcgaaagtccgcacaattcgtgacgaaaacggcatcgttgaagattacgaaatcgaaggcgactatcctaaatatggaaacaacgatgatcgcgtagacgatattgctgttaacctattgaaaactttcatgaagaaagtaaaacgcacaaaaacttaccgtaactcaaaacatacaacatcgatcttaacgatcacttcaaacgtcgtttatggtaagaaaacagggaacactcctgacggacgccgcgctggtgcgccatttgccccaggtgcgaacccaatgcacggccgcgatacacacggtgcgttggctagtctttcatctgttgcgaaattgccatatgactattcattagatggtatttcaaatacattctcaatcgtacctaaagcattaggacgtgacgacgaaacacagcaagaaaacctagcaactatgttggatggttatgcagcaaaaggtggtcaccacttgaatatcaacgtattcaaccgcgacacattgcttgatgcacaagcgcatccagaaaaatacccacaattaacaattcgtgtatcaggttatgcagttaacttcatcaagttgacaaaagaacaacaagatgacgttatcgctcgtaccatgcacgaagcaatgtaatagcacaaaaaaaggcggcggatggaacattccgccgctattgttatgaatcactgcgactgtgaagcagagcagatgatgacaagcgtagtttgttcatcaaactattgcctcactgcgagtatgggcgaggaatcaatggaataaaacgatgcaactttatttttagtttcttcaagaaaggaagagcaacatgtcagtaacaggacatattcattcaacagaaagtttcggatcagtggacggaccaggtattcgctttattgtctttatgcaaggatgccggatgcgttgtgagttttgtcataatccagatacttggaaaatcggtgccggtatcgaacggacgacagatgacgtactggaagaagcactcaaatatcgagaattttggggagaaaaaggtgggctgactgttagtggcggagaaccattgcttcagttggacttcttgatcgatcttttccgaaaagccaaagctgcaggggtgaacaccaccttagatacgtgcggaaaaccttttactcgggaagaacctttttttagcaaatttcaagagttgatgactgtcactgatttactattatttgatatcaagcatattgataatgatgctcataagaagctgaccacacaatccaacgacaacatcttagaaatggcaaaatacctttcagaaatcaataagccagtctggatccgtcacgtgctggtgccattcagaagtgattatgatgagtttttgatccgtttagatgcgtttatcaagacgttgaataatgtagataaagtagagattttaccttatcacacaatgggtaaatataaatgggatgaattagggctgaagtatccactggaaggaattgagccgccaacacaagatcgcgtgaaaaatgcaaaagagttgcttcatgtcgatgactataaaggttatcttacccgttaacaagcgtagagaagataactattgattctttcctattttttgctatcattagaaagtggaaaatgaatgaattaggagcgatcattatgtcgaaaatattagtatttggacaccaaaatcctgatacagatgctattggagcagcaattgcttttgcgcacttgcaaaaggaattaggaaaagataccgaagcagttgctcttggaacaccaaacgaagaaacgcaatttgctttgtctcattttgaacttgaagccccgcgtgtgattgagcagattgaggctggttcagaagtgatgcttgtggatcataatgagtttcagcaaagtgcagaagggatagcagaagctgccattttagctgtagttgaccatcatcgtatcgccaattttgaaactgcaaaccctctctactaccgtgcagaaccggttggctgtacgagtacgatcgtgttgaaattataccgtgaggcaaatgtagagattccagcagctattgccggaatcatgttgtcagcgatcgtttcagatacattgttgttcaagtcacctacatgtactgaggaagatatcgccgctgcaaaagagttagcagcaattgctaatgtggatctagaggcgtatggcctggatatgctgaaagctggaacaaatttaacaactaaaacagctgctgaattgttggatctagatgcaaaaagttttccgatgggtggaaaaagcattcgtatcggtcaagtaaatacagtggatttgaatgaagtgtttagccgccaagaagagctagaaacagcaatgaaggccgaaaatcaggcaaaaggttatgacttgtacctactagtcgttactgatattttgaacagcaattctgaattgctagtgattggagagccaactgcaccagttgaagcggcgtttaacgttgttttgacagcaaatcgcgcattcttaccgggggttgtttctcgtaaaaaacaagttgtgccgcaattaactgaaagctttaataactaatagctgacaggataatacgggcaaaaaagatgaacatttgaattggtcggacaatcagcaactgcagtcctttcactgtaataatgaaaggtttttggctagcaggggagcttaagattgtccggctatttttgaatgagagacggccctcctagtgggaatggaaagagagcgaaagacatggaatttttttatagtagtcattatcaagggattcagaaaattattgattcagagttgttctcaaaactgattcttttcttgaaaaaacaacaaaaaccaccaatcttaagagaattaaaacaaaattttccagagaaaaattttgaaaaaatacttgatcagttgatcgatgctgggatcattacccgaaaggatcgtcgctatcaagtggcatttcctatctattccacaaaagatcagcagaagagtcgtgagcgttggcaacaacctaatacgataattttagaagagttggcgttcattttacaagcggacatcatgagtgatcagcgctttttctatgcttgtgaagaaggtgtggtacaagcattcatttatcggctaatccatgagtcttttcagcttatttctttttccaaagaaaaatggccagcaacgattcccgctttttttgcagcaaatcgacaacaactgtcattgccaatttatcaggagctgttgcatttgctaggggatgttgatgaggcctattacttagatcaaatcagtgtcatctttgaacgggtggcaaaacagcgaaaaatccggccaagtatttttctcacatcactcatagaaggaaatattcttcagtcagaacagcgttttgatcttcctattgttgaggctgcatttctcactgagcagaatgggtcattgatgaaaggattgtccgaatttgatcggcgtacattattagcagattatcttggaaaaacatctaatccacaaacaattctcattacggaaatgataaaattttaataaatgtttagaaatagaaaagataaaaaagaaagaattcgttaaaaccctctttgggataacgttttctttctttttttgcattttttattatttgaaaatgattagaaaataacgagcgtattaattgattgttctcatttgaggtggtatgataactttagaattttgaaagagggcgtaaaaattggaaggaatcaaagcatttcatacagaagtgattgaagaaacaagaagcaaagcagagatgatcacttttgtttcgatggcggaaattgagcatgcacgaaaagaactttgcgaagccggtattcaagaaagccgcttttctgatggagaattaatttttgcacttaaacaaaaaaatgaatgtcatgcaaatacaatcgtaccaatcgtgatcgactggttattaatgaaaaactatttattgactccggcccaagctgttcgttttttgacgaataaattaggacagacagaatcagtatctttgaaagcattaggagatcttgagtttgacggggatggaaaatactttttgattgcctgtcgatcaatgaataagcaatataaaaaagtgtataaagtatatacagatggacaagtgaaagaactttggcgggcatgatcctttttaggatcgagagaaaggtcatgcctgtctctgaatggattaatcaaaggttgtgagtctcaggtgaaatcaaatcaaagaatcgtctttgcaagtagccatgtgtttatttttattcttagtatggtgtcggcacttttatttattttaaaagttcctaacacatttaatgcaaatcaaattttttcagagaatatacatttttcagacacagtctttgatgtggtcacaaggctttttttattgggcatctgtagtttatatacaacagttgccagcttctggtcttttcgttcttggccttatctttcagccggaattgggatcgctgcggtcataacggctttccagatgaaagttcaattccatccatttttgtttgctttatttttgatcgtcggtttgtttcaagtaagtgtcgcttcttatgtcgcttttgtttccaaaaaaagaagcagcactgaaacaggttgaaccaatcgtgttcaagctgttttttttctgccttaaatcttttgattataagcagaggatcgaaatacaacgaatcaggaataggaattgttctattccggcaatcgccaaggcttttacgttacgagatctttaatttatgctattctacatataggagcagcaatgctaaattaaagccatctgccctgaactattttcccagtgatcttcctaatattctgtttttagatggaaggttgattggctgaaaaaatagggttgatttaagaggaggtttgacatacgagtggaaaatgagcaaatgattacagcagagaagcagtttacgaccggtgaaaatttttattcacagcatcttttaggtgcacatcgtatgaaagcaggctatgtttttcgtgtctgggcgccaaatgcgcaaaatgtctggctagtaggtgacttcaatcaatgggatgactctttgccgatgacgaaacgctccgaatcggggatttgggaaattaccaccaatcagcctcaagaaggacagcattataaattcaaggtcaagcaagccgacggccgtgaaatcatgaaaattgatccatatgcaatttatttcgaagaacgtcctggaacggctgctgtcttgtacaccgtgccggcaaaaaaatggcgtgatggtttgtggcaaggccgcaaaaagcgtcaaaatcaatttaaacgaccacttaatatttatgaagtccatgcaagttcttggaaacaccacgcagatggaaccccttatcgtttttctgaattaaaagatgaactcattccttacctcaaacaaatgggctacacccatattgaatttatgccattgatggaacatccattaggcacatcgtggggttatcaattgattggctattttgcgctcagcgcttattacggcacaccagaagaatttcaagattttgttgaagcctgtcacttggaaaatatcggtgtcctagttgactgggtgccgggccatttttgtgtcaatgatgattgtttggcttactatgatggaacgccgacatttgaatatcaagatgccgatcgtgcaaaaaatgttcgttggggagcaatcaattttgatttaggcaaaccacaagtacaaagtttcttgctatccagtgcccttttttggatcgaattttatcacatcgatgggattcgcgtggatgcggtttcgaacatgatctatcgagactacgaccagggtgtttggcaaccaaatcatgaggggggcaatcgaaattatgaaggttattacttcttgcagaaactaaatgcagtcgtgaaactggcgcatccagaagtgatgatgatcgctgaggaaagtacctcagaaacgaaagttacaggcctgattgaagaaggggctcttggatttgattacaaatggaatctgggctggatgaacgatgtcctgcgtttttaccaaatggatccaatcttccgtaaggatcatttgagtttgttgtcgttctcattcatgtaccgcatgaatgaaaactatatattacccctttcccatgatgaagtcgtccatggcaaacgtagcttaatgcacaaaatgtggggagatcgttacaagcaattttcacaattaagaaatttgtatacctacatgatgacccatccagggaagaaactgctgtttatgggcagtgagtggggacaatttttggaatggaaatatgatcacgggcttgaatgggtcgatttatcagatgaactaaatcagcgtatgcagcaatttacaaagacactaaatgaactgtataaacaggagcgctcattgtgggaaatcgaagataaagaagaatcgctggtagtcattgatgctgataacttagcggaaacaacattgacctatttgcgacaaggtaaaaccaaaaaagatttcgtgatcgttgtattgaatttgacacctgttgaacgccacgatttcgccattggcgttccgtatgaagggacctaccgtgaagtattgaataccgaacgcgatagttttggcgggacttggacccagaataatcaagaccaacaaacagaagcgattccattcaaagaatatccttatcaaatcaaaacaattttgccagcacttggggcattgattataaaaccagaaaagattcaaatcaaacgcaggaaaaaatgaaaggggggaggagctggctcgaaagtccaatcgaagtgacaacgtgaaaggtgatatcgaaaagaaggctttttgaaagaaaagcattcatatcgaaaataacaccggcatcgtgaaagagattggctttttagcggctcaagaaaatgaaaacagagatgttagcgatgatcctcgcaggaggacaaggcacacgtttagggaagttgaccaaaaatattgcgaaacctgcagtaccttttggtggtcggtatcgtattatcgattttacattaagtaattgtgtcaattcagggattaagaatgttggtgtggtgacacagtatcaacctttggcattgaacagtcacattggaaacggatcaagttgggggttagatggtatcaataccggagtgacgattttacaaccctactcaaattctgaaggtggaaaatggtttgaaggaacagctcatgcgatctatcaaaacattgcctacattgatgaaatggaccctcaatatgtattagtattatccggtgaccatatctacaagatggattacgaagaaatgctggaaaaacacaaagaaaacgatgcgtctcttactgttgcagtgctagaagtgccaatgaaagacgcttcccgctttggtatcatgaacacagataaaaatgaccggatcattgaatttgatgaaaaaccagcagagccaaaaagtaacttagcttcaatgggaatctatatctttgactgggctcgcttacgcagcgtactgttaagcaattatacaaaagacggcgaaatggtcgactttgggaaacacgtgattccatcttacttggaaagtggcgacaatgtatttgcttatcgtttttcaggctattggaaagacgtgggtaccattgattctctttgggaagctaatatggaatttatcgatccacagatggaactgggaatccgtgataaaaattggcaagtcttctcaaaaaatccgattgctcctcctcatttcattacagaaacaggttctgcaaaaaattcgttgatcatggatggttgctatgttgctggagatattgaacatagtattttatcagaaaatgttcaagtcaaagaaggaactaagatcacagatagtgtggtcatgcctggagcagtcattgggaaaaatgtaacactaaaacgcgcgatcattggagaaaatgcagtgatcggtgatgatgcagtcatagacggaacagatgaaattgctgttgttggttattctgaagtgataggagtgacgattgatgagaactaataaaatgtgtgccattttaggcaatctgcaccgctacaaagaactgatgcccttaacggaaagtcgtccgttgtcgacgctattgtttgattgtaaatatcgtttgcttgatttcaacttgtcaagtattgaaaatgcaaatatcaaacaagtgtatatgatttttaatgaaggagaaacacaatccgtatttgaccatatcggtggcgggaaagaatggaatctagatggtgttcaaaaccgtttcttcattcatttgttccaagactcattaaaacagcaagctgctggtcaagagtattactataacgtgatcgattatttggaaaaatctaaatcagagcatacggtttatatgggcagcaatattttgtgcaacatcgatttgcgggcgttgctgaaaatccaccagttacagaataaagaaatgacggtcgtttataaacgaatcagcagcgataacgtaagtgacaacgacttaatcttttcagttgacgaagaaggccatttgaatgaagctgtccaagcgaagaaatgcgagacagaaagtatggtcaatctttgcactgatatcttcatcatcaaaacagaccgcctgatccaagctttaaaagaaggacaagctgtaggtgctactccagacctaggtcgtttcttgcgggaacgaatctctatcgaaaatactagcttgtatgaatatactggttatttaagcaatatttatgatattcaatcctattaccaaaccaacatggatatgttagatgtccacaaatttacctcattgctttactcaaatcaaaagatctacaccaagctgaagaatgaagtgccaacctattacgctgaaacttcggatgtcaaaaatagtcactttgcttctggttgtatcgtagaaggatctgtcgaacggtcacttgttgcccgtagaacaacgattcatccgaatgcccatgtcaaagacacgatcatttttgggaataatgaaatcaaggaaggtgctgaagtttcctatgctattctcgataaaaatgttgtgatcgcagaaggtgtcaaagttagaggaaccagtgacgcaccgatcgtcgtcaaaaaaaatacccatgtcactgaagatctaattggaggagcaacggcatgaaggtactatttgccgcagcagaatgcgcgccatttttcaagacaggtggactaggggatgtcgtgggtgcattgcccaaagaacttgtcaaaaaaggggtagaaacagtcgtggttctgccattctttactaaaatgtcagccgactatcaagaacagctggaagattgtttttcatttgaagtcaatgtgggttggcgtaagcaatattgtgggttgaagaaactagttctcaatcgtgttacctactattttatcgataatctgtactattttggtcgtgataatttatacgattattatgatgatggcgaacgttttgccttctttcaactagcaactatcgaaatgatggagagaatcgattttattcctgacgtgattcatgtgaatgattaccatacagcaatgattccttttcttctgaaagaaaaatatcattggatcaatgcttatcagaatatctgcaccgttttgacgattcataatattggctttcaaggatggtatagcaaagatattttaccggacttgtttggcatggggacagagcgttacgatgacgggacattacgattaaatgactgtttgaatttcatgaaagcaggtattttatacgcagatcgtatcacaacagttagtccttcttatagtgaggaaatcaaaacaccggaatttggttgcggacttgaagtcattctaagaatggaatctgggaaactgcaaggaatattgaacgggatcgattatgaaaccaacgatcctgcaacagatccattgctgccctatcattttacttccgatgaaatgtccggtaaagctgcaaacaagcaagaattgcaaaagatgctggggctaccagcgcgtgatgtgcctcttatcacagtggtcagccgcttgactacacaaaaaggctttcatcttgtaatgccggaaatggaaaacttattgcaatttgatgttcaatttgcgcttttaggaacgggagaaccggaatttgaagaaggattccgttactttgctgcaaaatatccggaaaaatgtgccgcggtgatttcttttgatattggactggcgcaaaaaatgtatgccggagcggatctgttcttgatgccttctgcttttgaaccttgcgggctttcacaaatgatcgccatgcgttacggaacattgccagtcgtgcatgagattggcggactaaaagatacggtagattcatacaatccaatcactcatcaaggcaccggatttggtttccaagagttcacgtcattttatttgatgaatgcagtgaaacaaggaatcctgctttatcaagacgaccagcaaacgtggaaatctttgcaagcacaagccatgaataaagattttagctgggacattagttccaatcaatatattgatctctaccaagcgatcaaagtataatcaagtataagacagaagtattcattagtctgaaagtagagcgggtttgacagaacgacctagcgacaagggcgattggtgcttctgtcctttttcatacaaattgatagtcataaaggagtgaattgtaatggagaaagctaccttgcaagaattattagaaagccggttgaaagatattttttcgatcgagatcgcagaagcttcaccgcaagaattgtttttagctttagctaacgtggtcaagagctgctacgcgaatgattggagccagacacgaaaaaatctgctcgttgaacagcagaaacaggcgtattatttctcgatcgaatttttacctggaaaactgttgaaaagtaatctactgaatttagggtttctggatactgcggaagagctcttcgaagagttatccttttcattagatgaagttgctgaagttgaaaaagatatggcattaggaaatggtggactaggacgattagcttcttgtttcatggattctttggcttcattagggttgccaggaaatgggaacggcatccgttataattatggcctttttaaacaaaagtttgtagatgggcatcaagtagagctgcctgacgactggttacgtgccggaaatgtctgggaggttcgaaaggagagtaaagccgtggatatccaatatggcggcgaagtgtacttgattgaagacgagaatgggaggctgcgtcctgaacggcatggtgggtatgtctggcgtgcggttccttatgataccggaatggttggctatcaaaatgatatgatcaatacattacgtttgtggagcgttgaggttcctgcagcggaagaagccaactatgcaaccattgaatctcgtcgttctctagaagatctgaccgctgtcttgtatccagatgattctaatgaacgaggcaagaagactcgacttatgcaagaatatttctttgtctcagcaggcattcaaagtattgttcgctactatttaaaattgaatcatccgctaacgatgatgagtgaaaaaattgctatccatatcaatgatacccaccctgcattatgtgtatccgagttgatgcggttattgttagatgatcatgatttgccatgggaacaagcatgggcaatcacagtgaaagtcatgagctataccaaccatacgattatggctgaagcgttagaaaaatggccgattgatctattcaaagaagttattcctcggaattaccaaatcattgaagaaatcgatcgtcgttatcttgaagagtatgcagaggttcacgaagctgcccttcttaatcggacgcgtattattattaatggccaagtccatatggcgcatttagcgattattggcagccatagtgtcaatggtgtcgcaaagctccattctgatctgttgaaatccgttgtcctacatgatttttatttgatattcccagaacgtttcaataataaaaccaatgggatcgcacaacgtcgctggatgcagttagccaaccaacctttatcaaaggtgcttgatacgactatcggcaaaagttggcgccataacccgcaagacttgcaattattgaaaaattaccaagaagatccaacagttttgcaacgtctagcagatgcaaaactgaccaacaaacaagcgttagctgaatatatccagcagacaaccgggatcgaagttgatccaaccgcgatatttgatgtccaaatcaagcggctccatgcgtataaacgacagttgctaaatgtgatgcatattttgaaactatactttgacttgaaagatgaccctcaagcaccgattcatccacgggtatttatttttggagcgaaggccgcacctagttatcattatgcgaaagccattattaaagtgatcaatgaagtagctaacctgatcaatcatgatccgacaatcaatgataagctgaaagtcgtctttttggaaaactacaacgtcacattggctgagcggatcattcccgcagcggatgtcagtgagcaaatttccttagcatcaaaagaagcttccggtacgagcaacatgaagctgatgttgaatggggcagtcacgatcgcgacattggatggcgcgaacattgagattcgagatgcaatcggagatgagaacattgccatttttggattaacagaagaagaggtctatgcttattatgcccaacaaaactattctgcgtatgcgttttacgaagaagatcctgtgctgcaacgggtcgtgaatgcatttattgatggaacgatcccaaatatagaaagagaaggtcgggaagtgtttgattcactattaaaatataatgatgaatacttcttgttgaaagacttcaaatcttattgtgatgcccaatatcgcgtggatttagcttataaagaccaacagcgctggcaagcgatcagcttgatgaatattgcgaatgccggcaaattttccgcagattatacggttcaaaattatgctgatgacatttggcagatcgaaccattgtatgcacatgtcaaagagccaaattcagctagtctgacgtaataatctattgtacttgctcattgaatattcccaaaagacaccacagctttcgtgaattattcactgaaatatgatatgattagataaaatcgcaaccagaggatgagtgaattggcaaattatttagatgtgaaacgcaaacatttccgttttccagcatatgatgatcaagaaggggtaaagctgcagtccgaacacaaggaagttttcagtcagtctgatgattggattttgacagaaatcaaggatcaacctagcacgagcagcaaagaaaaggattctgctcactcattgcgtcggaaagttccttccagtcaccccaattacggtcatagtgtgcggcaaaaagaagaattagcgcaacatcgggcaaatttaccaagctatggaaaacgacctttgcaggaaagtacacctaccggcaaaacaaatctttttggcaatgatcaacgacgtgcttcttataaagtgacgagtaaagcagaacgggctgaaacgccaacaccgaccaagaaagagtattctgggcgatcttattttgttcccaaatacattcctgcatcgatcatccctgaacaagaaaaagaagagatcacttcacaagaactgatggattcaatggagaaaccccgcgaatcctatttgctctttgatactgagccagcagcctaccaagtaaaagaaggcgatgatcccacggtcagaaagttcaatcgaccgcaatctgtaggcatgacacggcgggaatttcgcggcatgaacaaaaaaaacggcgataagcgagctgttctagatcgttccttagaaggaatgatcgaagaggggcagtcagaaagcaataaaaatggctactttcgctcttgatgagtaggacaactgaaataagcaaaggcactcgtgagaatctctcgctcaacaagcagttgggagttattcgttaataaaacaaggataatgatttaaacaacaaagaaagcaactatctgaattgtagatgaagctgtggcgctagcttgctggatgaagtaagctgacaaaaccagtcgctatcatctgtgatttggatagttgttttgtgcttcagaataccgctagtcttttcaaaaaatatcaagaaagctgaagcgacaatttccgttaaagaagcggcagctgtcctccttgtttttatttgttgaaagaaaacggtgactaacagatggcaacttctcaattattttcacttttgagaagcatttgctattcttaaaagaggagggatacgggatggaaattgatttgcaaatgttagcgatgatcttctttatcaatatggcttatgtcacattgaatacaattcgttttttattgacgatgaaagggtatcggctgattgcaccgctggtcagtatggtcgagatcacgatttatatattaggattgtcgatggtattggatcgcttagacaatccattgaacctactgttttatgcattaggttacgccgcaggagttagtgttggaatcaaaatcgaagatcagctagctttaggctatacgatggtcacggtgattttaccgacgaatacagatgaagaaaagaatttgccaaaaattttacgccaagaaggatatggtgttactcaaagttacggagaaggattagaaggtccgcgattgatccttgaaattctctcacaacgcaaaagcgagaagaaactgtttcaaaaaatcaaacaaatcgaagaacgggcctttatcattagctatgagcccaaatatatttctggcggcttttggacgaagaaaatcagtcggagagaagctcgggtcaaaaaagaacaaaaaaaggaatagctctttttctctcctgtgcgacggtccttttttgagatataataggcaagaatttggtttggaaggaagcgaatttgaatggaaaaacaagcaaacggcatgatggcggtgatagcagcactcatctcgaatattttagttgccatcagcaagtttgtcggctacgcattgagcggcagtgcggcgatgttgaatgaaagtattcacagcgtggtcgattgcagcaatcaaatctttctgttgatcggtgataaacgagcaacgaaagggcaaagtgaacttcaccaatttggcgaaggacgcgcgaaatacttctttagtacgatcgtagcgatgatgctgttttttggtgggggcgctctaggtgtaatggaagcttttgaaaagctgctgcatcctgctcatgaagttggtaatacttggctagtgattggtattttgcttttcggtttagttgtagaaggtagttctttgtggatcgcgatcaaagaaattcggaccttgaacgtagaaaagcagcctatttatcggtttttgaaagaaagtcgccatagtgagatcttgattatctttaccgaagacttttgtgcagtgattggcttgatgttggcaatgggtggaacgatcttgacaatggtcactggcaatgcgttttttgatgctttcagtggcttgctgatcggtattttgttgatgattgctgctatctttttggcacgagaattttacagtttattgattggcgaaagcgtgacgaaaagagatcttgtactgatcaaagaagcctttgatcgtccagatgtcgatcgattattggatatcaaaaccgttcatttaggtcctgcggaaatcttagtcgctgccaaaattgatatcacagcaaaacaagaggagatcggttatcaaatcattaacgagatcgaagcaaagatccgcagcttcatgccggataaaaaaatgtatatttatattgaaacggatgagtatgatcctcattatatggagaaacggcgaaaacttgtccgatcacaagactgatttttgtagaacaaagccagtttttttgatacaatagacaaggattatctaagacgaaggagaataaaccattatgatcaatgcaagtgatttaagagcaggaatgacattcgtgcaagacggcaaactaatcaaggtattagaagccagccatcacaaacctggtaaagggaatacagtcatgcgtatgaaattgcgcgatgttcgttcaggttcaacctatgatacaacattccgtccagaagaaaaatttgaaaaagctcatattgatacgaaagctgttcaatatttgtatacaatggacgatacagcgttcttcatggacttggaaacctatgaacaatatgaaattccggttgaagttgtagaagaagaaatgaaatacattctggaaaacatggaagtgaagatccaattcttcggcagtgaagtgattggggttcaattaccatcatcagtcatcttgaaagttgttgaaacacaaccgtcgatcaaaggtgcgactgtgactggctcaggtaaaccagcaacgatggaaacaggtttggtcgtcaacgtacctgactttatcgaagaaggcgaatctctagaaatcaatacttctgaaggtacgtacatcaaacgcgcgaaataatcattttctagaagagccaaggttttatgaacttggttctttttcttttagaaagaaggatcaacatgaatgtacttgttgtggcattttttgcattttttggcggcatggcacgttattttcttgcttcggaattgccgtcttggggcatcttccctttaggcacattactggctaattttattggctgttttatttttagctttttagtcaagcagatcatgacgaaaagacacttgaatggacgtttgatcttgggcatggggaccggattttgcggtgctttgacgactttttcatcctttgcacttgacacggtgcagttgctgcaaaagcaagcctatggattagcgacggggtatttgatcctgtcgatttgcggcgggttattttttgtctggttaggcgaagccctcgttagaaagcaggtgtaagtatggcatatatcgttgtaggaattggtgcagccatgggcgctgtcctgcgttatggtatcaatcgttattttgaacgaagaccacatccttttcccaaagccactttgctgattaatttatctggtgcgttgatactagggattcttgccggtcttcagattgatcaacacttgtatcttttgcttggaacagggatcatgggcggttatactactttttcaacaatgacgattgaattatttacattgctaaagaccaatcgccagtacttttatctttattttttcagtacgtacattgtaggattgacggctagttttattgggttgatgataggtgcttatttgaactgaaaaggagtagacgatgattgcattcatgtcagcagaaatgtggcttaaaagtgagtttttttattattcaatcgttccggttttattagtcgttggattagtggcgcttttacttttgctgatccttttgttgtatcgggagaaccggcggcagggtttgatctggctgcctgtcgtagttttgttgctttgcggcggcggtttcttgttaggagatcatttttttcacgactttaaaaatgacaatgcacaaattacgccaaatatccgcgatcgggaaaaacgctttatcggatataaatattatgatcagagcacgttggcggcttatcagcgaatccaaagtgaagccattccttctctggggatctatcaagcagaaccggttagccgagaaatccaatttctgggtattgcgcacaactctgtgtatttcaaactaggagaacagtattactatttgcgccaagagccaatctttgcgaaacaagaacaagctgagctgcaaggtgtccaataccatctgattgagtccgcttttgcagacatcggtttttttacagaaacaaacaattatttaacagccatcgttttgcctgagagcaaaaaagagttagtctatgaatccattgatgggatcttgccaaaagagtttggcaaaagtcaaacagcttgggcagtccctggaaaccaataaaaaatgtcattacatgagacaaaaggataggtgaatcatccgattcatctatccttttgtgatgtctttacttcccattgaagattgagcattcaaaacatttttttctttctgttcagtcaaataacgttctttgtgtttgcgcaccagttttttaaaggcagcttccgcttttgtggcttcactacgggtagcaaaacattccgcatggatcatttgtaaggggcgacgactagctggatgagtgtactttgctccaatgccttgattgtgttgatgcaggcggcgtatcaaatctgtggtataaccaccgtaaaaggtattgtctttacagagcaatacatagaagtaatgcgtatcagctgccataaagcatccgactcacttcctcactgtagctcccatccgcatgataagtgatcagcggtgaggcaatcttgaaaccatcagctttaccatccttgatgccctcgatcaataggatattcgcgtctttccctgctttgggatagacgaaacggacacgtttgggtgcgattcgatattttctcatgcagtctaaaatatccaaaaaacgatcaggtcggtgaaccatagcaaagcgcccattcattttcagcgctttactggctgtgtagaccacctcgtctaatgtggtctcgatttcatggcgagcaatcgccagataaggattaggatttttaacagcagtgggaacatttttgaaatagggcggattacagaccaagagatccaccgagtccggtttgattttggtaaagatgttttttaaatccattgggtaaaccgttatttgttcctcaagcccattcaagcttacactgcgttgggccatatcagccagccgatcctgcagctcgatctggtaaatgtgagccgaagttttacggctgataaacaagccgactgcaccatttccagcacacagatcaacgattcgtccccgtttgggaatcgttgggaagttagctagcaaaacggcatcgagggagaaagaaaagacctcgctgctttggatgattttgatatcttccgcatatagttgatctatgcgttcgtttgattgcaacatgaaagcatactcctgttctaattcatttcctttgtattatactacgattaagaataatcggaaacgacaaaaaaggcttgtcatttgaagcgtttttttgcatacttataaaagaaactggaaaggaaagtgagtatgttttttagctttatgcgaggcgtggttcgggtcattttgtttttgatcaacgggaacgcccgatatcaaaacaaagaggctttgccgcaaaatgaaaattacatattggttgcacctcaccgtacctggtgggatccgttgtatctggcggtggctgctcgtcccaaaaagttcagctttatggcaaaagaagaactgtttaagaatccaatcttgcgctttattttgattcatgcgaatgcttttccggtaaagcgtgacaaaccagggccgagtgctgtcaaaacaccggtgaaaatcttaaaagatacagatctgagtctcattatgtttcctagcggaacaagacattcgaccgcgctgaagggtggcatggcactgatcgccaaaatggcgaaggtaaaaatcgttccttctgtttatcaaggtcccttaacgctaaaagatttatttaaacgtcgacgagtaaccgttcgttttggggaggcgatcgatatcagtgatatcaagaaaatggataaagaagggttagcagaagtggaacgccgcattcaaggtgcttttacaaagctcgaccaagaaatagatccgaattttgtttatgaagtagaagagaagaaacgttgatgcgtttcttcttttatttttgactgtgttttaaataaatattgaacttgataattttttgaggatatgctatgagataatcaataacaagggtttagttacaggtttagagggcctattatggcaaatagtaattctttgatttcagatgttcaaaaattatttgtgaaagtagaatatataaatacaattagatacttgttttatagtgcaaattaaaatgaagatttttacacatcgaggaggtaaaatgatatgaagccaaaagaaatactttgccaatgggttgacgcatttaatcatgcggatgtagaaattatttcagaattatatgatgacaatgcaataaaccatcaggttgccaatgagccagttattggaaaagaggctataaagaaaatgtttgaacaagacttctctaacgcagaaatggtttgtatcgttgaaaacattttcgaagatggacaatgggcaattttagagtggcgtgacccgttaggtttgagaggttgcggtttttttcaaatagtaaataataaaattttatttcaaagaggctactgggataagctatctttcttgaaacagcacaatttgcctattgaataaaatgaatagatatcttatataaatagtttgtaaatttcttaaaaggtgcattaaggtaaggataataatttcccttaatgattgttagaatagtaacactgcgttaaaacatagtcttatttctaatttctaaagtaggcttgcttcgtgcttcttacctaggaaaagcagctccttattggtatgctcaaaaaaattttaaaaaggagtctctgttagacagaggctccttttttagctcatcaagagttattcagtgactggttgattttccttttccaattcatttttgtcatagatttttacaaatggataataaatgaggatggaaagtacaatcaaaagaatgtttaagacgattgctcgccagtcaccgcctgttgcaagaaaggcaccaattggtcctggcaatgtccaaggggcattgacggtcactttgttgactaaaccagccgaggtggctacccaggcaattacaccattgactaatggtgcaatgataaatggcggaatcaaaattggattcaagacgataggcgtcccaaaaatcagcggctcattgatattgaaaatagcagggatcaatgcggtttttcctagttttgatccgaattcggattttgtacgaaaagcaagcaagatcgccagaccgatggttgaccctgcgccgccgatccaaatgaaccattggtagaatggctcagcagcaatgttgggaatcacatcgccagaagctaacgcagtggtgttgccttccaataattgcagccataacggccgtgccagtgaaccaacgatcgaggcaccatggatcccaaaggaccaaaagaatgtcgttaagaaagtgatcaataagacacttggcaagctatcggctgcgctaactagaggatcaacaacttttgctacgatggtatgccagtcaaagccaatgtaataggtgattacccccatacctaaaataatgatcaatgttggcgttaaagcttcaaaagatcgagcaacagcaggagggacttgttccggcatcgtgattttaaatttagatttatccgtcaaacgataaatctccacagctaaaatcgatgtaatgatcgctacgaacatcccggcactgcccaagtttgccattggtaaaacaaatccggctgtaccagcagcctccaaagcttcggggggaatatttattggcgtgaaagtcaataaaaaagctgtggtggctaagataccaccagagagaccatcgagtttataggaacgggctaagctaaagccgatcccgaatgcggcatataaactcataatgtacatcgtcatgcggtaaggaagcaagatcgtggtcgcatggctcgaaagaaattgatagattccccagtcttgtggcaggggaggaaaagccaaaatcataaaaaatgagctgacgataatcagtggcaaagtagagacgatcccatcgcggaccgcccgtaaatgccgttgactccccagtttttccattggtccagccaggtgacgttcaatgaactgtgtaaatttatctaacattttttaacctcctgtgaaaacgttcatatggttgaattaataaagttatgttgggtgattccgctctcctatgggaccaaatggatttgggatgatctttcccagaatcacggattgtttggcaccagtcgcggcaggagcattatttttatgtccctgtaaggtctcgtatcctaaaagggcaaatgccatagcttctttcgcatcattggaccaacctaaatcattttgggtaatcactgtaatctcaacgggtaagtagttgaccagcattttttttagtgttgaattatgcgcgccgccgcctgctaaaatcacttcaatgggtccgctttcaacaagtgggaaaacgaagcgccgataactctcggcaatcgagtaggcagtaaaatcggtcactgttgctattaagtctgctggtttttctgcagaaaaatctgctaatagttgatcactgaatgcttgaccaaatagttcccgtccagtgctcttagggggtgcttgatcgaaataggaatgatttcttaattgtgtttgcaatttaggaataatggttccctgttgagcaatccttccttcagcatcgtaaggaagttggaataattgatgcatcagttcatcgatgatcatatttccaggaccagtatcgaaggcgacaagatcacttaatgtgccatttttcggcaggaccgtcacatttccaatcccaccgatattttgcaataagcgggttttatcaggggaacgatacaagagataatcagtataaggtacaagcggtgctccttgtccaccagcagccatatccatcgcgcggaaatcggcaaccacagttgttccgagtccgtaggcaatgattgacggctctccaatttgaaacgtactggaaacaagcgggttttccgagggtgcatgccaaatagtttgtccgtggctagcaacaaagtcaatgctagtttcggttactgctgtttcttggcagacctgacgacaagcagcgagaaaggcatagcctagctcaacatttaactgacagatcaaggaaacagaagagtcctccgggtcacaggcttgttttattctttggcgcaactcgggggaaaaagcagtagtcgtcagatgcaacagacgaatagatggctgtgaatgattatcgatttctactaatgcggcatcaacaccgtctaaactagttccagacatgagtccaattccaagcattgtttctcctcctttcttttgtgtttgtcgaaaccaaattagatgaacttgggcggaaatgtattcggtttcaacctcgtctttattgtagtgtatgtgtaattgcatttcaatgatttttttgtaaaaggaaatttaatttcattaatttgacaaatcagtgtgagaacccgtttggaaaaagaaggactcaattgtctgggaacgagaagatcacgttgatacattcaattcataatcgtaaagtggtataatgatgggaaggatatttttaagagggtgggtatatgcgttttttacatacagcagattggcacataggtaaaaaattacacggctatgatcttctcgaagatcaaagttacattattgaccagataattgatctggcggaagaacaatcagtagatgcaattatcattgctggggatctttatgatcgcacggtgccagccgttgacgcagtgaaatgtttaaatgagaaaatagcgaaaatcaatttagaaaaaaagtttcctttactagcgatttctggtaatcacgatagtccgacacgacttgaaactggaagtccatggttcaaaaatacgcaattttacctaacgacctccattgaagaaagtattgagccgattgaattttctgacacccagtttttcttgttaccttattttgaaccgatcgaagcgcgtttgttttttgatgaaaaaatcacaacgatcgcagaaggggtgactcgggtccttcaagagatgaagcagtattttgattctacgaaaaaacaagtcctggtgactcacttttttgtagctggttcaagccagacggattcggaaaccaaaattcaagtaggcggattggatagtgttccgacaacggcgtttgaagggtttgactatgtcgccttaggacatctgcatgcaaatactgcgctaaatcatgaacgaatccgttatagcgggtctccgttgaaattttcattgtctgaaataaccaatgagaaaggtgtttatatcgtagatactcaaaaggaccagcagcatttttatccgttgcggccgaaaagagatcttcagcaatacactgcttcttttgaaacattgcttgatcctgccttttatcggcaagtggatcgagaggccttcttacacttcacgttaacggatcgagccgtaattcctaatatgatgaatcaattacggcgggtctatcctcgaattttatctgtggagcggcaaaatgggcgaaccgtcagcaagaaaaatttgacattagccgatgaggaggatccgcaacgggtgatcgcccatttttataaagaaatgactggagaaccgttaaatgagcagcagcaaaaatggctcacaggtttgacagcgggtggagagaaggagcgagagaagtcatgcagccaagaaaattaatcatgaaaaactttggtccctacattcatgaggaactggattttggcgactttcaagaaggtggtttgtttctagtcagcgggaaaaccggggctggcaagacgacgatctttgatggaatgacatttgcattatttggagaaacttccggaaatttgcggtccggtaaagaaatgcgttcgacattcgcttcccccacagaagagacgagtgtccgtttttcctttgatcatcaacatttgcactatgagatcgaacgacgtcccgaacaagtcttagccaaaaaacgcggcgatggagtcacgaatcaagcagctaaggtacggttgacgatctatgatcagcaaggaaaagagcgcaaacaaatcagcaaaaaaaatgaagtagatatcttcatcaaagatctgctgcaattggatgccaaacaattcttccaaatcattttgctgcctcaaggagaatttcgcaattttttgatcgccagcagtaatgagaaagaaaaagttttgcggaatatttttggaacggaaatgtatcagcgcttcaatgaatggctgaaagaacaggtcaaaaagcaaaccaaacaaattgaaaaacaacaaacggcagcggatcatttggtcacacgctttgagtggaccgaaccggcaactccggtttcgttggttgagacattagcgtactggcagacagatcttgagaaacaacgaagtcatcagcaaacaattgaagcaaaaaaattccaagcggagcaagagaaaaagaccgcacaggaagctttttatttggcaaaagaaatccataaagcacttgccgagcaacaggaactcagccaacaggcagcgaatctagctgcgaaagaaagtcaaattttagacgataaactgcggctgcagcagctagactgggcgagtgagcatcaagaaatcttacgccaaaaagatgagcggacagctgaagtagcacaggctattcaacaacttacattcaatcagcaatcattagaacaatggcaagagtctcaagagatatgggacaaaagccgagaagttcaggtagatcgaaaggacgaacatacagcagctaagcaacgtttacaaatactggcacagttaaaaccattagccgagcaagttcagcaacaagaaaaacaggtcgcttctttgcaggaaacggtgactcaacaggaaaaacaagcgcagcatctgaaagaacagcaaaatcttgctatgaatcaggagcaaggattaaaagaagaaatccaaaagcattcgatctaccaagtacaggaagtccaactggttcgtggagaaaatctgttgtaccaatggcagatgttgaaaaaagaggagcagcagctgactgatacccaacagcaactaacagaccagcagcgaaaattgcaagagaagcagcagcagttagtaagtaaatatgatgagttaactgaagaattggtgcaagaaaaaagtcgaaatgccaagatgcagattgctcgtttgagtctcttattggtggagggggaaccttgtccggtctgtggctcttttgaacaccccgctgctcaaaaacatacagagtatagtaatgaagaaatcattgatagcgagcagcaacttgaatctttggagaaccagctgcaacaagttggtgaagaccgttcgacgaacttgctgctgctagaacaagtcaatgaccagtttcaaacaattaaacaaaaaatgagcgcgttgaaggaaaaacaacagacaacgtatcagacactgcgagaaatcctccagccgttgatggaaaatatgctaggtcaaacagtcctgaaagaaggagctggcaaggaaccagctgacccattgctggtagaaggattgactgaaaaggaaatttccactacctatttcaaatgccaacaaatcaatcagcagttgaaagagcaatttgctctagacagacagaaattgacagaggtccaaacaaacagccaacatcttacagaagaattgacagcacttgaagcaagtctcaagactgctagtgacgctttacgtttggaagaaggaaaactgtcctcactaaaagagcaaacggagggagtatctctggagcagttgaacgaggaacaggagcaactagcagcacaatcgtctcgtttagcagctctgattgaagcggatcagttggaagagcaacgtttgaaggaacagtatacgatcctgacagagcagcaacgaaatctgcaacagtttctagccgacaagcaacaagctgctcagctagcccaagaacgcttggaagaagtcttgcctgcggcatgtaccgaacaacagatgcgcagtctgctcaatgatcttgaggaacgccaggagctacgcagtacgataaaaacctatgaacaacaacaacgttttgttcaacagcgacagcttgaactggcacaatttttgcaaaacaaagctgtgcctgacttggaagtcttgcaagaacaagtagaccagtctgaaacagcggtagaacaattacaagaacaagtaatccgaggaaaagaacaaatcaagcaaaatcagcgattacttgaagaattgcagataatctatcaacaaaacaccaagcaattagaaaaaatcagccatttacagcaactatcagaagtcatcaatggagaaaatgaaaagaagaccagtttggaacgctatgttctgcaacgatttttaacagagatcttagaagtggcgaatgttcgcctagctcgattgacaagaggacgttatcaattcgagttggcagacaaagtggggagctatcgaagctcgacagggttggagatcgatatctatgatgataatgctggcagtcttcggcgagcacataccttatcgggtggtgaaagttttattgccgcattggcattggctatctcattagctgatgtgatccaaaatcgttcgggaggcatcgagatcgaggcgttgtttattgacgaaggatttggctcattagatgaagaatcgttggaaatggcgatggaagcattagaaatgattgaaaatgaagggcggatgattgggatcattagtcatgtaagagaattaagagagcgaatcttgcagcaagtcgttgttcaaacagatggcagcggacaaagcaaaattcgtacaaaactttagagaaaggaggaatcagaagcatatgaaatggagtattccagaaaaagtcattgaaagaggtcggacctatctaaatgaaggtcgcgtcctatcggttattccagatccagagagaaaggtatggcatgcggaagtcttgggaagtgagctatatttagtcgatcttgatgcgacggctaaagagatcgattattgccaatgcccctattgggaagaacatcactattgtaaacacactatagctgttgaactttatttacgaaagcaaggcaaaacaagacaaatcacagaagaaaaaaagccaacaaaagccgcattttcggcttcggagatgttttctcagggattcaatcgattgcagtctggacagcggacgatcactcctttgcaaattgaatatcgtgtcgaaaatctgaccacgaacccttaccaccaggagatggatgttctagggatttcactaaaagtcggtcaacggggaacttcaaagacgtatgtcgtcaaaaatatctataaatttttgcaagtctatcaagaaaaaaagagctatctggcgaacaaacaaacagagtttcttttaacgagtgaagcatttgaccaaaccaacaatgatattctgatccgcttactaggcattgctcagacacagcagctgattggacaagctggcatccaagtgaaaggcaaactagacaaaaagtatttgctattgccagttgaatacgggaaagaactattagagaaaatgaacgctgcttatatgcagttaacgattggcaacgctaaacttcgtcaagtgactttttctgaaggcaagccgctgcattttcgtgttcaaaaagaacacggtcaatttccgttatctttgacgagggattttgatcacttgctgagctattacaattggggccttcaaggcgatacgatcgttgaattgacgatggaccaaaaagaagtctatttgacgatgcagcaattattcaaacgctttgaagaaccaacgatcatttatccaaaagcggaactgtccaacttgtttatgcaagttttgcctcatttacgcaagatcggcacggtagagatcacaaaagaggtcggagcagagatccaagagagtccgttagccgttgttttttcactgcgtaaaatcaaaggtcagatcgatttgcaaattgatttcaattatggcgaagtgactttttcgactgacgaaaagcatcaagtgattcctgaggcccatccagagattttaagggattaccctcaggaaaagcggatcgaacaagtagttgaaagaatgaagtatcaaaaaagtaccaaaaattggttcaaagcgctaccggaaggggaagaattgtttgcctttttcactcgtgaaattcctttactgcgccaactaggagaagtacgtatcggcaaaaaattgcgggaactttacttagatgcacagcagcaccgtccaacgatcgaaattgaagaaaatggttcctggctggatattcactttgatgtcagcgggatcgctgaatcggagatcgatgctgtcttgcggagtttgttgcaggctgatcgtttttacacgacagaaaatgggcaagttctttcactggaaacagaagcctttcaagaagcaagcgccgcgctgaaaaaattacggacagcctttgtatctcagtcaggtacgttacaagttccgttgaaccaaggattgtatttgcaagaagaactagctgaccaagcaacttttagtcaaggattcaaacaaatgacgacagatttgattcatccagaaaaattttctgcaccattgcctcatcagctccaagcgcaattaagacactatcaggaggtcggatttcgttggctgaagatgctgagtcagtatcaatttggcggcatacttgcagacgaaatgggattagggaagacagttcaaaccatcagctacttgttgtccgaaaagcaagagaagcaacagttgaatgctctgatcgttgcacctgcgagtttgacgtataattggcagcaagaaatcaaacgctttgcaccaatgatccagtcggtggtgatcagtggttctcgggaggaacgcggcagccaattacagctgccggcagatgtccgcatcacatcttatgccagcttacggcaggacatcgaccagtaccaagaattaggtttagcgtatttgatcttggatgaggcgcaaatggtcaaaaacagcggaaccaaaacagcacaagcattgcgttctttaaatgttccccatcgatttgcattgagtgggacacccatcgagaataatcttgaagagttgtggtccttatttgagatgatcatgccgggatttttcccaaataaacaacgctacaaagaattgacgacacaagagatcgcaaaaatgatcaagccattcatattgcgacgcgataaaaaatccgttcttcaagatctgccagagaagttagaaacgaattattatagtgtactgacagaagagcagaaaaaaatctaccttgcgtatttgcgccaaatgcgggaagaaatcgcacaaatggatacagcagcatttcgcaaaaatcgtatcagcatcttggctggccttactcgtttgcgtcaaatctgctgcgatccgcgattgtttgtggaagattacgaaggcacatcaggcaagctagaacaggtcaaagacctgattcaagcagcaaaagaaaacggccgccgtgtgctcttattctcacagtttacaagcatgctttcgatcattgaagaagaacttgctcaagaaggaattgaaaccttctatttacgaggaagcactcctcctcaagaccgtttgagtatggtcgatgctttcaatagtggagaaaaagatgtctttttgatctcattaaaagccggcggaactggattgaatctgacaggggcggatacggtcattctatatgacttatggtggaatcctgcagtggaagaacaagccgctggccgggcacatcgaatcggtcagaaaaaggttgtggaagtttggcgaatgatcgctgaaggaaccattgaagaacgaatggatgctttgcaacaagaaaagcgggaactattccaaaaagtcatccaagggaatgaagcccagctgaaccaaatgacggaagaagatattcgcttgattttaagcattggtgaagaatagattcagcgaatacaaaacccttgatacgaaagcaagagacagctaggatgcgaagatttgcatctatagctgtctcttagtttttagcgagccatcacaactgcatctgtaaaggataagataccttctgtcagctcttcaaaagcagttaacgtacagtcagggtgacaatttttgatttcgggagcttggcgtcggcgatgattcagccaaagggcttgccatcccgcttgtttacagccaaagacatcattgtcaaagttatctcccacgtataatgtccgtgagggatctaaatcaaatcgttcttcagcaagctgaaaaagttcaatatccggtttttggtaccctgttgcttgagaaatcagcatgtattctggatggatccagcgagtcaattccaattgatcgattttcttttgttggtgatctgttgggccattggtaatgattccaagcttgataggtaatgaaaccaaggtattgagagtttcttctacggctggatgaagttggatgttgtctagctctgtctcgtaagtcgcttgaaacaatcggctagcatcatttgataaaggagagtagcctaaatcaatcagcgattgacatagtctaaaggtacgaaattcttctaatgtccattcttttgagatgacttttccaaaatggtcatcgctatgtacgcgaaaacgaatataaagaggatggagatctgttgttgctacttcaggtatgatggttgtaaccgcatttcgaaatggtagttgttgatcgtataaagtatcatcgacatcaaagattaccgcattaagcaaaagagacacgcctttcaaatatagtgaaaattttcattttgttttcgaacatataatagcggatatcttgagagaaaaaaagggcttaaagcttgataaataaaggttttatttactaattttagaaatccttggtctcatcgctttttcaaatttgagtgaattttacccttttcaatcgatttctcattttgcttttccagaaagacttgcttataatgtagattaatgaaaaggaggaggaagtgtgttaaaaaggttttttagctattatcggccataccggtcattgtttgtcttagattttacttgtgctgtctttgcagggctgcttgaattggtttttccagttgccgtgaatcaagtgatcgacaagattatgccgcagaacaattttcggctgattttgctcgcttgtttggggctatttttattttatctggtcaatacgatcttgcaatatatcgtggtcttttatggccataaattgggtgtcaatatcgagacagatatgcgtcaagaattattccgacacttacagacacagtcttttgaatattatgacaatcaaaaaactggacgtttgatcagtcggctaacgactgacttgtttgaaatatcagaagttgctcaccacggtcccgaggacgtctttattacgatcatgacattgatcggttcattcttgctgatgctcaatatgcatgttcaacttgcacttgctacttttgcactgattccattgattacgattgcactggttttcttcaataagaaaatgacgaaagtcaatacagagatctatgacaatctaggtgaattcaatgctggggtagaagcagcagtcagcggcattcgcgtgactcagtcttttgccaatgagacgtttgaacatcaacgatttgacggtctgagcggcctttatcgtcgttcaaaaatcgtcttttataaagtgatggcaatcagttctgcctataattactttctgattcgactgatcaatttgtttgccttgatttttggggcctattacgtgatcaaaggggaattgacgaatggacagtttgttggatttatcttgttatccaatgtctttgttcggccaatcgaaaaggtcaataccatgattgaaagctatccgaaaggatttgctggcttcaaacgcctgacagaagagctggacaagagaccggcgattcaagataagccaaatgccatcgatgtacacgcactaaaaggcgatatcgtttatcaagatgtttcctttgcttatgcagatgcgacgaaggtattgaaccatattgatctaacgattcaatccggcgagactgtcgcttttgtgggacaaagcggttctggaaaaacaacgctttgcaatttactgccgcggttttatgaagtaactgagggtcagatcacgattgacggaatcaatatccaagacatgacgcttgcctcactacggggccagatcggaactgttcagcaagatgttttcttgttcccgggaacgattcgagaaaacattgcttatgggaaattggatgcgtcagaagaagaaattgctcaagccgtgaaactcgctcatttagaacaagtaatcgaccaaatgcctgaaggattggaaacagtcattggagaacgcggggtcaaactttctggtggtcaaaagcaacgggtagcgattgcccgaatgtttctaaaaaatccgccaatcttgatcttagatgaagcgacctctgcgttggatacagaaacagaacaagtgattcaagaatcattgaattcattagctgatggacggaccacattgattattgcccatcgtttggctaccatcaaacatgcgacaaggatcattgttgtcagcgataaagggatcttggaagaaggaacccacgagcaactgttagcaacagggggacattacaaagcattatatgatgcccagttcaaaaattagacgaaaaaagcgacttcgatcgcttttttcgtttatatgcaaataaacatattcagtggatatcgctgatttcttcaaagagatttgttaggatttacttatcaaacgctttctttgtttgtaacatttgtcatattcgttgccgatgaaatgatttttcactcataatgagcaactaatgacttggaatagaatacgtgataatacagattttcgtttctttgaaatcttttaataacaagttcttttctctgtttgtaagtttttaacgagttttaggtgtaaaaaaagattggtaaagaccaatgaaagagtactagtattatagaaagaaacttgtatagaggagtcagatattatcgaatattttatcaaaattaaaaaacgatagaattaaatcactagagtgatttaaataaatctatggttcatgatacaattttgacacactgttatacaaaagaaatgaaattaaaaaaaaatttgatttttctcatttaaattgatgtaaagtttgtgaaagcttttgtttgagaggtttctcttttaatataacttgagagttttattaaaaaatacaaaatttacactagattttttttaaatagttctgtataattaaaatcaagcaagacaacagaacttgcgaatggaatttaaaaaaggagagatgcacgttgttgacactatatacttccccaagttgcacatcttgtcgcaaagctcgtgcgtggttgcaagagcatgagattccttttgttgaaagaaatattttctcagaacctttaaatatttctgaattaaaagcaatcttacaaatgacagaagatggtacagaagaaattatctctacaagatccaaagtttttcaaaaattgaacatggatcttgatgacctgccgctaaaagatttattgacacttgtacaagagaacccaggattattgcgtcgtccgatcatgattgatgaaaaacgactccaagttggttttaatgaagatgaaatccgtcgtttcttgccaagagatgttcgtcaactagaactacgtcaagcacaattgatggcaggcttataaaaatcaaatagttatgagatcagtgaatgaaaagctgatctctttttttgccattttaggattttcttaagaggatatgcgttttctctttacttttcaacaggtttcgttaaaatgaacctatagtgattagcaaaagtgaggtgtagctaatatggaaatggaacatatcaatgaaaatacgatccgtgtactgatcaagagcgaagatttagctgctaggggcatcacttttcttgaccttcttggaaatcacaatgagattgaaaactttttttatagcatattagaagaagtagatattgatgaagaatttaaaggcagtgaagcggtgaccttccaagtcttacctaaaggggatggcttagaattgtttatcagcaaaaatctaccgcctgaaggaatggaaaactttgatgatatgagcgatggttcaactgaggacattacggatatgttgaagaagcatgtcgcgtcacaattacaagagacagagtcccagccggagttaggcaatcgttttatttttgaattgaacagctttgaagcaatggttcaattagcgtccgaagtgtatttggattcagtgaccacgaatctttatcagatgaatgaccgttactatctagaagtccaatttatggataacgatacgacagacatcgaagttgagaatgcactggcttatttaatggaatttgctaaccggacacaagtcacttcagaggttttggcagagtatggaaaaatcattatggagcatgacgcattggaattgacccgttactacttcaaaaatgtctaatgttcacttataatcgtaaaagcgagaaaatggctacaatcattttctcgcttttttgcgtatttctttttgaggtgagaagatgattattgcgtatgacaaccagcagcagcggatcaaagctgatcaggcgaagaaagattcagaaccattttattgtccaggatgtcatggaccggtgcacttaaggaaaggcctcctgaaacgccatcatttcgctcattatgctgcggctaactgcgaagtgtttagtgaaggagagacggaggaacatttgtcagcaaaggagctcctctacgaatggctaacagatgaaacgatcgaaatagaagcttacttgccggatttgcagcagcgaccggatcttcttgtgggcaaaacagcgattgaagtacagtgttcggctttgtcttggagccgctttgtccaacgaacagagaagtatcttgcctataactattctccttggtggcttctaggcaaacatctacaaccgcaactccaccatcgatggaccgttttgcaaaaggcctgttgccgttttgcggagcaaccggggttttatttgtggatcatagatacgcaagagcaacgcgttggtctcatatacgagatcaattggcattataagtggggtgtttcttttcgtagacgttattttcgaaaaggagaacctatcggctgctgcccatcgctaaacaattattctagaaagtcctgtcgaacataccatcaaaggtggcagccggaagcttaccgagtctggttattacacaagttgatgcaacagcaaaaacagatcctcagtcttcaagcactcctttaccctctcggaggacatatcggcaatctgccgcattggtgctatcaacccagtgattatggttttttgttggaacatcgaattttagtcctgcgctttttatttcatcaaaatgcaaatcgaaatttttctcactggctgaatcagttgcgcaaaatgaattggaactggttgtttcctatgattgatcaagggcaactattgaaacgtatttatcaagaatgttctgatttccagaaaattcaacctttttgattctcttagctcggttcccaccaaaagtatgttaagattattttagtatgtaaaggagtgaagaatatgtcagaaacaaaacaattaccagatcgtgcggatctaccggaagcattaacatgggaccttacaaagatctatgccgatgatggggcatttgaagaagcgttccaagagatcgtggctgagttgaagcaggctgatgatttcaaagggacattatcacaaggaccagcagctttcaaggaagcattagaatatgtgttagcgatctcccgtaaactggaaaaactctatgtatacagtcatctgaaaaatgatcaagatacagccaacacaacctatcaagggctttatgcaaaagccagcaaccttgttgctcaagtaagtgaggcgattgcctggtttgatcctgaattgctttcaatggatgatgcaactatttggggttatttcgaccaagagccggaattggccatttaccgccatcttattgaaaaaactgtcaataaccgtccccatgttttgccggctgaacaagaagctttactagcaggtgcaggagaaatattcggcgcttctggaaatattttttcagtattaaacaatgccgatttagaatttccgatcgttgaagacgagaatggagagaaagttcaattatctcatggtgtttatggtcaattgatggaaaataccgaccgttccgtacgggaagctgcctttaaagggttgtatggtgtctatgagcagttccgtaatacatttgcccaaacattaagtaccaatatcaaagcccataactttaaagctaaagcacgccactatgagtctgctcgacaagctgcattaagtgccaaccacatcccggaaagtgtctatgacaccttggtagctgtcgtgaatgaacatttgccgctgctgcatcgttacatggagttaagaaaacgcttattggctgttgatactttgcatatgtatgatgtctatacaccaattctaggggaagctccgattcgctatagctatgaagaagctgtcgcaaaagccaaagatgctttaaaacctctaggtgaagaatatttagccgtggtaaacgaagcgtttgaaaatcgctggatcgatgttgtcgaaaataaaggcaaacgcagtggcgcctattcatctggcgcgtacgacacattaccctatattttgatgaactggaatgatcgtttggatcaattgttcacattggtgcatgagatgggtcacagtgttcacagttattttactcgcaacaatcaaccttatgtttatggcgattattctattttcttggcggaaattgcttcaacaactaacgagaacatcttgacagaatacatgttgcaaactgaaactgatcctcgcgtaaaagcctatgtcttgaatcattttctggatggatttaaaggaacgattttccgtcagacacaatttgctgagtttgaacactttatgcacgtagaagatgccaaaggaacgccattgactagtgaatttttgagtgacagctatggtgagctgaatgctaaatactacggtccttctgtagaaaaagatcctgagatcagtctagagtggtcacgtatcccgcatttttactacaattactatgtctatcaatacgcaacaggcttttcggcagcttctgcactagctaagaaaattttaacaggagagcctgatgccttaacgaaatatttgacctatctaaaagcaggcaacagcgattatccaattgaagtgatgaaaaaagctggagttgatatgactaaagcagattatatcaaagacgcgatgaaagtctttgaacaacggttggatgaattggaagcattagtcaaggaattagaagcataagcaagactgtcttagccactgaaggatcgttgatcgatcgtcagtggcttttttaagcaacaggttgattgccttattttgacggtgacgcctagaaaaaaagtaagtataggaaggatttgcttgtcaacagaaacctcaatttaaactttaaagtgagaaaatctttttttatgagtaagcaaattgcaagaagcaaaagtatttccatgttacgatagaaatgaaagaggaaagggggcctttggaatggacaaggaagaaatttttgcccgtcgcttggataatagcaagaaaaaacgggaagttgtcacgaaagaagctgtatctgcccacaaagagaagcagaccgaattagagcagaccgaattgccggatcaagaccctacagataaaaaagatccttcaaagaaaaattctgataggactgaatagaaaaaacatccaaacggtggatccaccctttgacggtctcttattaataggagaccaccaaaacgagggtgactcgatcagcgtttggatgttttattgattgtttaaagcaagacaagtcgtcgattcaacgagtcgatacgaggaacatcagcatccctgatatctttcttttgatagaataaacgatagttttcctgatctgttcggcaaaggtgtggaatatttctaagagcttccattccttctaataagacaccataatctcgttcacaaccgaaattatacactacagccgaaggagacatcgtaatgcccatttcgcgagcaacactttggtcggatgcgaaattctgcttgatcaaatcagacttgcgatcttctaaaaacatgtcaagatcgccgtttgtttcagcgaaaatctgtttgactaattcgaaggaataaggttctttatttacgcctacttgacattgaagtttaagtaaaaagtcgcgggcgatttttcgaccttgaagctgagctgctttgtagtccaatgaagcctgatagatttgactggtttgttgattacgcaatcctagatcggatcgatccattgaaaggtaatccattgaaatccccacagtgtgtaaattcatgattggtaatatatgcaattgtattttttttctttgatcactcagtgcgtccaacaaggtcaactcggattgataacaaattggacctatcggattcacaaacaaataaatctcgatcatctgaatctctccccaattaagattctttttcttttgtatatattaaatataacagaaattattataaatgagaaatgcctaatgagaactattcatactctttttttgacaacttctcttctaaggcacgaataattttattttttgctggacgataactgatatgcaggcgatcaagcaaagacaaaaatgctcgttttcctgaagaagcctctgagacttccagttcgagctcatagtcatgggattggccataccagctttcatctaaagcaagtaaaccttctgttacgctgaattctgctcgacgagtcgtcaactcagcaaaaggtttcacagctgccggatcaatttgctcttggatcaagcgatcggcaaccgcaccggtaaataagattctttgattctcacgcaaatcagctgcttcatctaacgaaaggatatcggtcgtttccaataacccttctttaagaggtgatttaagcgttaattctgctttatcttccgtcgtccgaatccgcaaaccaaactttttttgttttaattgatgatccaatgtatcaaaataaagatttgtttgggtatgaaaggcggagcgatcaagctgatagaaggcaaagactctctgatattcttcacgagtcaacaatgttttaaattcgatttctacttgatgtgtcattgttttcctctttccttacagtccatcaagtttacataacgacgggcaatatgtcaaatgaaaacccttggaagagttgaagcaaaaaagagctctgttatttttcttgcaggtggcaccgattgaacattctgttttcctttaagattgtggtaaaatagaaccgtatgttatgaaaagaatcgagggatagaaatgattcgagattgggaagattttttggcaccatatgaacaagccgtctcagaactaaaagtaaagttgcggggaatccgcaaacaatatcgagaacaaaataaacacgtgccgatcgaatttgtcacgggtcgtgtaaaaccagtcgatagtattttaactaaaagcaaattgcggggaatccctttggatcgtttagaagaagaaatgtcagatattgccggcttgaggatcatgtgtcagtttgttgaagacatccatcaagtagttgatcttttgcgcacccgacatgatatgaaggtaattattgaaagagattatattacaaataaaaaagcgagcggttatcgttcctatcatttagtgatcgagtatcctgtccaattgatcgatggtgaaaagatcattttagcagagatccagattcgtacattagcgatgaacttctgggcaacgatcgagcattcactgaattataaatatcaaggagaatttccagatgaaatcagcgagcgcctgcgtcggtctgcagaagctgcctaccaattagatgaggagatgtcgaatattcgcgaagaaatccaagaagcgcaacggctgttttcacatgggaaaggcaatcataaggaacagcggcagggggatgaagtatgacagggatcaaagtagcaattatcaacaatcaagaagaaaagtcgatgcttgtcacaaagcgattaacagaattgttggcccagtctgacaatacgattgaccaagagaacccagaattggttatttcagtgggcggagacgggacactgttgtctgcgtttcacttgttcagtcatcgcttagcagaggttcgttttttgggggtccatacaggacatcttgggttttataccgactggcgagactatgaattggaagaattggtcgatacgttgtgcaatgatcgtcaaaagagtgtgagctatcctttgcttgatgtccgcatcacttataccaatgggaaatcagacaaacattttcttgcattgaatgaatcaacgatcaagcggggaaatcggacaatggtagctgatatttcaatcaaagaagatctttttgagaaatttcgtggagatggcttatcgatttcgacacctacaggctcaacagcttacaacaaaagcgtgggaggggcagtattgcatccaagtatcaatgcttttcaactagcagaaatcgcttctttaaacaatcgtgttttccgaacgttagggtcaccgatcattgtcggagatcatgagtgggtcaaagtcaaactacaagctagtacggactatctagtgaccattgatcaatttacgattgaacaggaagaaatcgatgcgatttattatcgtattgcagacgaacggatccactttgcctcctatcggcatatgcacttttggaaccgtgtcaaagatgcgtttattggagaaatttaacagttatggaatttacttatcattatgagcggcaagagccgcaacagttaaaatactttttgaaagagcaagggatttctaaaggattgttggcaaaaatcaagtttcaaggaggcaagatttttgttaatgaccaaagacaaaatgtcttgtattctttggtgcaaaatgatacggtaaccattgtgatcccagacgaaggtgaacatgaaacggtcttattagatgagacgccaatcgagatcgtttatgaagaccagcatcttttgattgtaaacaaaccagcaggcattgcctcgatcccggctcaatatcatcctaatgggacgatggctaatcgtgtcaaagcttattataaacagcaaggttatcaagatcaggtcattcatgtggtcactcgcttagatcgggatacatctggattgatgttgtttgccaagcatggctttgcccatgcgaagttagatgttcagctgcggcaaaagcaattgataaaaaaatatcaagcaatcgttgcgggacagattcaagaattggcttctcacggagaaatcacttatccgattgcacgagatctcagttcattattaaaacgaaaaacaagtttggaagggaaatccgcacgtacggaatattggttgacgaaaaaggatcagcaagttgctgtggttacgattcttcttcataccggtcgtacccatcagattcgcgttcattttgctgccatccattgtccattactgggagatgaactttatggcggtgcgatggatcttggcattgatcgtcaggcccttcattgttgcgaattggcttttacccatcctttcagcggcaaatcgctgcattttaaagcagacttgccggcagatatggcatcaatcaaacaagcaatgagtgaataaaagaggtgaagagattggatgaaaatcaagaacttaatgagcgctttgagcagctgactcaggcgttgaatgaaacagatatccaaaaatttcgtgaagtgtttttggatctgcatatttatgagcagggacaattctaccaatctctcgatgagtcgcagcgccaaatcgtttatacgtacctttcacccaaagagttggcggatatgtttgacgtgatcgaagaagatgatgaacatatgacagagtatctttcggaaatgcgtcccggctatgcggctgacatgctagcagagatgtataccgacaatgccgtcgatcttctgaatacgttagataagaagcaagtagcaaaatatttgagtttgatgccggcagaagatgctagtgaaatcaaagagctcctgcattatgaagatgagacagctggttcattgatgacgacagagtttgtttcgatcgtggccaatcaaacggtacgatccgcaatgtatgtcctaaaaaatgcagcagatgtcgccgaaacgatttactatatttatgtcgtcgatacggacaacaaactggtcggagtaatctctttgcgggatttgatcatcaatgatgaggatacgatgattgcagatattttgaatgaacgggtcatgtccgtgcatgtgggggatgatcaggaagatgtagctcagacatttcgggattatgactttctagctttgccagttacagattacgatgaccatttattagggatcgtaactgtcgatgacatcattgacgtaatcgatgatgaagctgccagtgactattccggattagccggggtcaacgtggaagaagtcagtgaaaatcccctcaaagcctcttcacgacgcttgccatggctgatcacattgcttttcttggggatggcaacagcaagcttgatcagtcattatgaagagcttgtaagtgaagcaagtattttagccgtttttatttcattgatcactggtacagcaggaaatgccggtacgcaatctttagcggttgcggtccgccgtttggccatctcagatgataaagaaaaaagctttatgcgaacggtgatcggtgaagtcctcacagggttagtgactggtgctgtcaccggtttaacgatttttgcgatcgtggctgtctggaaacaaaacccgatcttaggttttgttattggaatggcgatgttgtgtgccattacggtagcgaatctcgcaggaagtctgattccaatgttaatggataaattaggctttgatccagccgttgccagtggtccattcattacgacacttagtgatttgactagtgtcttgatttatttcaacattgctagcttatttatgaactattttattcgttgaaaaaactaggtattcctttcaatcaaagtagatccattcatcaaaagcgaggcgcctcttttctataagagacgcctcgcttttttgtcttattcgtatcgatgatgggaccatgatggtaaatttatttttgcaacttgggaataactgacgaaggagaaacgccaaaaagttttttaaaagacttgctaaagtgatacgcgtcttgataaccaacagcagaagcgacttctttgatcgtgagtttctcgtttgtcagcatatctctcgcacgttttagccggatctcgattaaataattgattgggctgactccagtagcctctttaaaaacttttgaaagataggttggactgagaaactgatcttgtgcgagcttttctaaagtgatttcttctttatagtggttctctaaaaagtagatggtgtagttaacgatttgttggtggcggcgttggcttttcgtgagatagggaaccacattcaaacgtttgtcgtttaagcctcttaatatatagaccagcatctcgatgatcaatgctttttgcattaattggaattcatcttgctcctcattactctcccgaacgagctgccacgctttatctaaaacttggtggtggtattttcctaaatccagtaacggttgcttgttggggaaaaagttgcgtttgaatccttctaaagaaatattctttaagccaatatgcagttggtgggaacaagtccctgactcctgaaactcacaatgattgacaccagggttaaacaacatgatactgcctgccttgattttagtagctggcgcctcttcaaaataataattgctttctccttccaaaacgatactgatttccaagaaatcatggtgatgcatttctccatgactttcagactgtgtccaaggatcaaacaagtagataatttcgggattaaaggttctgggatttactagattcattcatttatcactccaatggtgtcagaacctggtaatttcaggtcgacggcttcttagtaatattttacatcaaaatgagtaagaaaaaccattttaatcgcctagtaaatcgctaagcttaacaacgagagggggaattagatgagtaacacacaatggatctggcgatatgcgaaaaaaaatcgtggccgaatcattttagcaatcctgtttttacttattaatgctgcgttgatcgtcgtcaatccatatctagggggaatggtgatcgatgatgtgatcaatcagcagcaaacgcacttattgattccattattactgattatgatcgcaacgacagtgatccgaaccattgtccgctatgcgtatcaactattatttgaacgagttggacaaaacacgctctatcatttacgagaagatttgtatcacaaactgcaagaactggattttgacttctttaatcatacgcgagttggggatattatggcgcgtatgacaggggataccgatgctattcgacactttgtttcttgggtgacctataatatagccgaatgttttttgtggtttttctcagccgtagtggtcatgagttttattgactggaaattgatgcttgctttagtcgctgtgacgccaatcatctttctattaacgaatcaaatgtcaaaaaaagctcatccattgttctttgagattcgggaaagcttttctcggttgaattcgatggtagaagaaaatattggtggtaatcgcgtcgtcaaagcatttgccagagaaaattatgagatcgacaagtttaaagcgtacaaccaagatttcaagacccgcaacatggcttctgccgaagtatcccgaacctatttgccttggttggatggattagccggaagtttgaatgtcattgctttggtcttaggaggaatctttgtgatcaatggagacatgacattaggtgatctagtggcattcaacgggtacctatggatgttgaataacccgatgcgaatgagtggctggctgatcaatgatgttcaacgtttttctgccgcctgtatcaagattcgtcaaatgctcgcacaagagtcgaaaattcctgtccatgaaaagaaagccttggaaccaatcaaaggctttgtggaatttaaacatgtttcctttcatttttccgatgatccggatcaaaatgttttggaagatgttagctttaaaatcggacctgggcaaacgttagggattttaggtgaaaccggctctggtaaaacaacattggtcaatcttgtaggccggttttatgatcctactgagggtgaagtgctgattgatggcaaaaatgcgaaagaatatccggtccgccaaatgcgggagaacatttcaatggtcatgcaagatgtattcttgttttctaacacgatctctgacaatatcgcttttggaaatccgttggcagacgaaaactttatccggcaaatggcggtggtagcggatgccgacacctttatttcccgaatgcctcaaggttatgaaactatcgtcggtgagcggggagtaggcttatccggtggccaaaaacaacgtatttcattggcacgggctttggcgaaagatccatcgatcttgattcttgatgataccacttcagcggttgacatggagacagaatccaagatccaacaagagctaaccaaactaactggagaaaaaacgactttcatcattgctcatcggatctcttctgtccgtgaagcagatcaaattctgatgatggaaaaaggacgcgtgatcgagcagggaacccacgaagaactagttgccaaaaaaggcagatacttcgaggtataccaaaaacaattgggattgactggaggtgacgacaatggcgcgcaataaatttgatgtggatgaagaactggaacaggagttcagttggaaagactttaaacgattggcccgctatgtcgtcccttataaagcgagtatcggtaaagttctctttacgatcatcttagccaatttggcgggaatgcttgctccggtatttacaaaaattgcgatcgattcagctattcctgaccagaataaaatgcagctgtttttgatcggtgctgcgtttgttgtgacactgctgatcattggactgtgcatgcgttaccggatttatcatattacgaatattggccaagacgtcttgaaagacatgcgttacgatatctttgaacatttacagcgcttgcctttttcctattttgatacgcggcctcatggaaagattttgatccgtgtggtcaactatatcaatacactgagcgatctattaagcaatggactgatcaatctgatctccgatgttttcaatgtagtgatcacactgattttcatgttagtcatcgacgtcaaactgacattgtattcattggcactcttaccgatcttgttcgtgatggtcatggtgattaaaaataaacagcgcaaagcttatcaagttttaagcaacaaacagtcgaatctaaatgcgtatattcacgaaagtatcgctggtatcaagatcactcaatccttcgcccgtgaagaagaaaatgcccaaatttttgaagaagtcagcaatgattaccgtacatcttggatgaaagctgtcagagtccaatttttgatgtggccaggggtgcaaaacatctctgtgatcactacttgtctgatttactttgttggtattcgtcaaatcggtgttgatgtcagtactggcacgttgattgcttttattagttacatcaataatttttggaatccagtaatcaatatcggaaatttttataattcactgatcacggcaacggcgtaccttgaacggatctttgagacgatggatgaagtaccggatattgaagataaagctgatgcgatagaattgccgagcatcaaaggggaagtggctttcgatcatgtgactttccgttacgaagaaggcaaaaatatcttgtctgatgttaacttccagattcaggcaggagaaagtattgcgttagttggtcctaccggcgcaggtaaaacgacgatcatcaacttgttgagtcggttttatgatgtgaatgaaggcagtgtcaaagttgacggttatgacgttcgggatgtgaccttggaatcattgcgctcacaaatgggtgtcatgctgcaggatacttttattttctcggggacgatcatggaaaatattcgttatggaaatctggcagcaaccgaagaagaaatcatcgaagctgcaaaaatcgttcgagcccacgagtttatcaaggagttgaaagatggttaccacacagttgttgaagagcgaggaagtacgttatccgcagggcaacgccagttaatttcctttgcccgagcattactggcagatccaaagatattgattctagacgaagcaacttcaagtattgatacaaagactgaagagctgctgcaagaagggcttttaaaacttctggaaggcaggacgtccttcattattgcccatcgcctgtcaacgatcaaaaattccgaccgtattttttatgtcgctgggggaaaaattgctgaatcgggcaatcacgaccagctgatggccttaaaagggctctatcatcacttgtaccaatcacagtacgatttgttgcaggcgatatgataaatggtagtaggctttgcgcaaaaaaagacattcgtttatcagcgaatgtcttttttgcttaatgatctgtcaaatcaacgattttcgttccgtggagttcagagacaccaagctgatcggcaattgactgggcattcttgtatgaaatacctgcacctggtaaaataatcaagcggtctcctgcatagtcgatcaatgcttttaaccgttctaagttctcttcgatagctgttcctgctggcccgccatgtgtgaggatgcggtggacgccgtgatcagcaagccaatcaatggcttcaaattggcgagattccggaatggcatcaaatgccatgtgaaaagtgatctgtaatccttcagctgtatcaatcagaagttccagtgcttcctcatcgagccagccgttcggtgtcagacagccaaagaccacaccatcagttcctaatttcttggcttcgatcaaatcggtgtgcatgatttttaactcgatgtcattataaacaaaatcaccgcctcttggtcgaatcattgtcatgatcggtacacttttttcaccagcgtaactcagtgcttcttcaatcacacccgtgctaggtgtggtcccgccgacagccaaattgtcgcataactcgatccgttttgctcctcggccgatcgctaatgggatcttcgtataattttcggcacaaaattcttttaacatctgtttccctccgtttttcagctgttattctatactagcattttaccataagtctatgctaaagtaagaaagagaagagggatttgatatgttaaaaaaaatcgatcgtgggcgactttttcttgaggcccatagcgacttatttgagtgtccattgtgtcatcagcaggtctttgccaatgagagtggactgatttgtctgaatcgtcatcgttttgatctttcaaaaaagggtactttattttttttggatcatcctgtgaaaacggagtatgatcaaggaatgtttgttcctcgaagtcggatgatccaaagtgggatgtatcgtccagtcttagagggcatctcccaccagattgaacaatccgaaaacattttagatattggttgtggggaaggcagctttcttgcccaattattagccggacaagaaaaaacggcagtaggatttgacattgccaaggaaggcatctatttggcaaccaatcatgctgcttctgccttttggtgtgtcgcagatctcacgaatcttccttttgcccccgctagttttgatacgattttgaatttattttcgccttccaattatcaggaattcgaccgcatcttgaagccgggcggacaagtgatcaaagttgtgccagcagcaagctaccttaaagagctgcggcaagctttttatccagatgattctgcaaaacaagtctattctaatgaacgtgtcgttgataaattttttgcaaaatatccgcaagcgagccgagaacggatttgttatccattctcaatcccagaagaccggcgactggacttgttggcgatgtcgccattggagtggggtgcgtcaaaggagcaaatagcaaaagttcgggaaaacccgttacacgaaataacagtcgatattgagttgttagtcgcgaaagtttcttgaaaaatttttgaacttttttgttatttacccttgcaatcatgtcatgggagtgatatattgttcttaagtcatttttcattggtttttatcaggttcctgttctgataaaagttagtgaaaagagcttcactaacgtaacgactcgcagtgattgacaccgagttggtacgtttttttttatgctcaaagtttcagtaaatcagatagaagttcgcaaaacgattttcgttaaaatatggtactatagaatctattgagagacagttggctcgaaccaattgaaaggagtcttaccagatgaatcacattgttttatttgaaccacaaattcctgccaataccggcaatatcgctcggacttgcgcggccaccaatacacatttacacctaattgaaccattaggcttttcaacagatgataagcatttgaagcgtgctggacttgattactggcatgatgttcatattacttatcacaaagatttagcggcatttatgtcctttttaggtgatcgtccactgtacctgatctctaagtttgccaatcgtgtctattctgaagtagattatacgactcatgaagaccaatttttcctttttgggaaggaaacaactggattgcctgaaacattcatgcgcgaacatgcggacaaatgtttacgaattccaatgaatgatgcccatgtccgatcattgaatttatctaacactgccgcgttgattatttatgaagctttacggcaacaagggtttccagagctagaattgactcatcactacgacaatgacaaattagattagatacaatcgataggagagacttgttcgatgcaattatattttactcgtcatggcaaaacagaatggaatcaagcacgacgatttcaaggaatgatgggcgattcaccattgttgcctgaaagttataaggagatccagcttttgggagacgcaatcgcaaatgttccttttgaaaaaatctattcaagtacctcgttacgtgcccgtacaaccgcacaagggatagtggaaagattaaagcaaccagtcgagattgtttatacagaaggattacgtgaacttggactaggcgatttagaagggcagttcattgatgaaatgcaggcaaaatacccgcaagagctggctgatttgcgccaccatcttgaccgttatgacccaacgatatttcaaggagagcccatcgaagatgccctgaagcgcattgaaacagtggtgatgactgctgtgcaagcccacaatggtccgttactttttgtcggtcatggggcctcattgacggcagctatccaatggttggccggaaaagaattggcacaattgcgggaacaaggtggtcttgttaataatagcttgaccattttagagacaggagcagataaacaattgccttttgagatgacctgttggaatgatgcaagttttctagaaaatcaagacagtttagatgccttactataggtgaaaggagcggcgtcgtgaatccagaaagaacattttttgtcggccatgttgccgcgatcttttttcaaaatcctagcaatttctataaggtacttttagtcaaagtgacagaaaataatgcggattacaaagaatctgagatcgtcgtcactgggagctttggtgagatccaagaagaggagagttaccgattctacggtgagttagtcaatcatcctaaatatggcgtccaattaaaagtggacagctatcagcaagaacaacctacatcagagcaaggtctgatcaattatctttcaggagagaagtttcctggtatcggtaagaagacggctgaaaaaattgtggggcttctaggagatcaggcgatcgatcgcatgttagaggacccggtattgttggagcaaattcctggattgaatgaaagcaagcgaaaaatgattcttgatacggttcgactcaatcatgggatggatcaagtgatcgttgggttaagccgctatggatttggtagtcagctttcttttgccatttaccaagcatacaaaaatgaagcattagagatcatccaagaaaatccttatcaattagtcgaagatattgaagggattggcttcaaacgggcagataacatcgccgatcaattaggaattgaagccacctcgccccagcgctatcgtgcggcagttttgcaccagatttttgcccaatctttacagactgggaacacgtatattcacgcacaagatttgcttgagcaaacacttcggttgttggaaacgagtcgacccatcgaaattccaccggatgacttggcaaatacgattattggattggtagaagaaggcaagatccaacaagaagaaacgaagttgtatgaaaacagtctctatttttcagagtgggggatcgccaattcgatccaacgattattagctcgcaaaaaagaaatcaactaccccaaaaaaacagttgaaaaaacactgcgaaaaatcgagaagcgattagggatcgtctatggatcttcccaagaagaagccatcaaagaagccatccattccccattatttattttgactggcggacctggaacagggaaaacgacagtaatcaatgggatcgttcaattatttgctgaattgaatgatcttgatttagatcccgcaaaatacacggaagaaatgttccccatcttgttggcagctcctacaggtagggcagccaaacggatgaatgagacgacgggacttcccagtgggacgattcatcgtttgcttgggcttaacggccgtgagaagacgcctagtgtcgctgcgaaagaacttgaaggcggtttgttgattgttgatgaaatgtcgatggtggatacgtggttggctaatacattgttcaaatcgatccctacaaatatgcaagttatttttgttggcgacaaagaccaactgccttcagtaggaccgggacaagtgctgcatgatcttttagaaatcgaacagattccaaaacaagaattgaccgagatctatcgtcaaggagatgggtcaagcatcattccattggctcatgcgataaaaaatgggcaactgcctgcagactttacccaaaatcaaagagatcgctctttctttgcttgtgatgcttacaaaattgaaccgttgatcgcacaaatcgtgcaacgggcgaaagcgaaaggcttcacaccgcaagacattcaagttctagcgccaatgtaccgcggagcagcagggatcgatgcactaaacaagatgatgcaggaaatctttaatccaaacgatgggaccaaaaaagaagtcacttggaatgaaacagtctaccggatcggagataaagttttgcagctggtcaattcgccagaagacaatgttttcaatggggatatgggacaaatcgtcggcattattcctgccaaacagtcagaagacaaagtggacgaattagtgatccaattcgatgccacagaagttacctataagcgaaatgaatggaataaaatcacattatcctattgctgctcgatccataaagcgcaaggaagcgagttcaaaatggtgatcatgccgatggttcatcaataccaacgaatgctgcaacgaaatttactctatacggcagtgacccgcagcaaagagctgttgattttattaggagaaccccaagcttatcaaacatgtgtgacacatgagtccgccactcgactgactaccttgcaagagcggatcaacggcagcgacgagatgacacctttgcaacgtcaaaggttggcacagtttgaagaagcagatgatcctttctcagagtctaactcacagacaacagccacaatgaaaagtgaaaagaaaacagatactgcccgtgagccggtgagcagtaagcagtcggttcagaaacaggaacttgatttgtttgccacaacaccgagtgaatccatcatcgaagaaacactaccggaaggaactatctcaaaagaaccgctttcgagagaattgacaatcgaaatggttcaaaaaaatgtggttgatccaatgattgggatggaaaatctttctccatatgattttctcgtctcttaaaaaagaattttttacagttaatgaaaatgagcgctttcttttggttttttagcgaaacatgctaagctaataccaaaaggaggcgttttcaaatggcgaaagaaacagatgacaaattagaaaaattagcaaaagaatccagcaataacttcaagaaattggatgagttggagaaagaatacaaacttgatgaaagtccagatgccgaaaacgagcaaggagaggaaaccgagttagagaaaaaattagacaaagttccgccagtttgggcaccaaacacaaatccgactaacccaaccaatccgaatagttcaggaagcatttaaggctgaaatcaaaaaaacgcgtaagaggagattgcctcttacgtgttttttattgtaaatgctggtaataataaatggctaactgggtacgatcccgaagttctaatttttctaataacttactgatataattgcggaccgttccttcgctgagaaacaacgcttgcgcaatttctttattgttttttccagtggcaatttccttcaagatcattttttctcgttctgagaaatgagtagtcaaataagagtcattattttttaacagtgtaggaaatttcgtgacgatttcagcgccaaacactgcttggccattgtatgcagctttgatagagggtacaatagccgaaagattttgcttgatgagatagcctttgactccgagatccaaagcttctcgtatataggcatcatcatcaaaagtagttaagagtaaaatgacggcattcggatcccgggttaaaatcttgcgagcagcatctaatccagtcccatcgggcatccgaatatctgttagtataatcgcaggttttctttcttcgtacaatgcaactgcttctttggcacaatgaccaatgcctgttacctcaatttcgtttgaaacttccaagatggtttttaatgatgcggtaactaggggatcgtcatcgatgattactacttggatcattggtcctcctccttaggtaaaataatcgtaagttgaaataaattctctttttcaagggcatggagttgtccgtttacctggttgattcgctggcgcatcgtctgaaaaccgatcccgtgggtgtgattgagcctatcctttggtttgtcattcttgatttgtaatcgatgaaaagcaggtagttgtttaaaatcgcaagtcacttttgttgcttgactgtgcttcatgacgttggtcaaggcttcttttatgatcgtgattaggacagtttgttgtgtttgagagagaatacttggcggtgttcctattacctcaactgtacaaaattgaaagtctgatagcaaaagatctaatgcttgtggaaaaagaagcgagtgatgatgtaaatcgtgaacactttctcggatgcggtccatacccaagttcatggttcggttcaattgatccaatggtaagtgaagttgcttattttgattaattgcttgaatggcacctaattgtaagatggcacttgaaagcagatgaccaacattatcatggatatcacgagcgattcgattccgctcttcagcgatctgtaaggcgacttctgtttcttgagagcttttaaggtagtcgttttgctcacgcaatcggctctcattttcccaattggcatcttgagtcgagttgaattttttttgtaacgaatgaaattcaaaactatcgtttcgcaagtaagaagcagagtagaccaaaagcatcagtataatccgtatcggccaagaaggaaccaaggaaaataagagtatacaaagaatgagcaggaggatcttttcttgcttttcaccaatctgggctgaacgaaagacgcatgggaaaaaatagctataaattggccaaaccaaactaagacctatcaaaatgcccaatgccagccacgttccttttttgaatagcagacagagaccacttaagatgattgttgtcaaaagatagattaagtctagggcttggaagccattcagggacattagccctccacagagaagaaaataaaaaacaacctcattaatcgacaatggtttattcatatctggctcctaaataatgacaaatgtcatttttgttttggcgtatcctcactagttattcttttcgctttttattatagtcagaataagaagtgtttggaaaggagttttttcgatgattattgaaattgataacttggtaaaacgttatggtgattttctcgcattgaatcattttaatttgcaagtcagggaaggtgaagttctcgggcttttaggacctaatggaagcggcaaatcaacagctatcaactgtatgttgtccttattatcttttgataaagggactattaaattgtttggggaaaaaatgtcaccgacaagttatgaaataaagcaaaaaattggcgtcgttccgcaagatatcgctgtatttgaagagttgactgtctacgacaatgttgattacttctgtggtctgtatgttgctgacaagaagaagcggaaactattgatcgaggaagtcatttcgcttgtgggattagaagagttcaaaggattctatccaaaacaattaagtggtggcttgaaacggcgtttaaacattgcttgcggcattgcccataaaccacaactgatttttcttgatgaaccaactgttgccgtggatccccaaagtcggaacaaaattttggacagtatcaaaaagttgaatcagcaaggtgcaacaattgtttatacgactcattatatggaggaagtcgaaatactttgtgatcagattgtgatcatggatcagggacaagtcatcgcgaaaggaacaaaagaagagttgaaggacatggttcgaagtacggaaaatcttgtgattgatatccctttacttccagatacagcgatcgaatttatcaagtcattgcctcaagttcttgaaactgcctatgataaagagcgtttgacgatcacagccaaaaagatgaaagagattcttttaccagtactaagctatttggaggatgaacatatcgcatttactaagattcacacaggagaagcaacattaaacgatgtgtttctggaaattaccggtaaagaattaagagactaggagggagattatgtttggacacttatatcggtatcgcttgaacgttttagttcgtaataattccttactattttggacattgatcttcccgattttattagggttgatgttttctgtagcatttagcgagattgatcaagctggaacgatcgagacgattcccgttgggattatcaaagaagaacaaaatcagaaaacaaatgagggacaactgactcagcaagacgcatttatgaatgttttgaagcaaacaaaatctggtggagaaccattgttttcactacaagaagtctctcctcaagaggctgaaaaacgattagatgcaggggatcttgctggatattattcctttgaacagtcatcgatccaattggctattgcacgtaccggtctttctcaaaccattctaaaaaacatgatggaccgatttttacaaaatactgacctggccaataagttggtggcaattgactctactttgacagaagaccagctcacatcttttctagttggagaatcttttgttcagcaagaaaatcagactagaaacatgagtatcaaaagtttttatttctttaccttggtgggaatggctattttgtatggattcatgtggggggtcagaaacgcccaagaccagcaagcaaatcagtcttccaaagggattcgcctttcgatcatccctcgaaaccggttgctggttttttcagcaaatatccttgctggattcacgatatttttcttagaagttttagtgattctaagtgtttttcattttatttatcaagtcgacttcggaaaccgctggcagtggttattcgtcctatccgctttgggtgcattgaatgcattattattagggaatttggttgggaatttgcttcctaatatggggctggcacaaaaagaaggattgggtgtggctgttacaatggcgatgagtttttttgctggtatgatgggctcccaagacatcaaatactggatcgatctgcacattccggtgctaggaaaactgaatcttgtcaacttaattagtgagagtttctatcagctctatttttatcgctcactagaggatttctatttgaatcttttctggttagtagcctttatggttatcttagcctttagtaatctaatgtttgaaaggagggttcaatatgtcgctgtataaagccgttttgaaaattttaaaagcgaacaaaacaaatttgttgattgcagtcattgtaactgtgatcatcaccttcttctatgcgcaaaatacagcagcaccggatgcaaaattggatcgggggacaatgaccattgttacagaagacaactccgcattaagtaaagcactgattgactatttaaaagaagaacaaacggttgtggaattgtctgataagagccaaaaatcgattgatgatgcgctgtattttggaaaaatcgactatgttttatttttgcctaaagattttactacgaatattgaagcaggtgtaccgtcagcaatcgatgcacaatctcgtcccgatgcttttgctaaaacattgattgaagggcaagtagatacctttttgtcgacttatacggctttttatcatgtaactggcaatagggaagaggcattgaaaaatacgcaatctactttggccgcaaatggcgaagtaacgattagtcgtggatacagtgaacggatgaaccagcaattcggcagcttagtattcaatgcacttgcttacggtttgtttctttctatttttagtggctatggcgtggtcaatctagtgttcaatcggaaagaaatccggaatcgcaatcaagtatctcctttatcaacacggcggttgaaccgagccgtttctattggtatgttggggtattcactgcttctgactagttgttttacagcgggattactcctatttactcgtagcacgtggtccgtcatgaccggctatctagtgattaatcttttgtgttttttcttgccgattgtcacattttcaacgtgtattacgtcatttgtcaaaaatagtgaggcgttgaatggaatttcgaatgtgtatattatgggaagctgttttttagggggagtttttgtttcatcagattttttaccagactttattagtaagatcgcttcttttacaccgacttattggtttgtacaaaacaatcaattgattgggaacaccctctctgtgaatgcggatttcattacgaaattctggttgaactgcttgatattggtcttatttgcctgtgcctttttgataatacagttcgttttgaaaaaagacagccgctggtttaatcaaaaaagggttgcatgagtcataaaaaaatgatgccgctgactcaacagctgcatcatttttctaatctcactatttctaactccatatcaattgtttggtagtggttatggtgatatcaaatggccgcttacccatttcttcgccgtcttcttgaccatgctgtggtactgtggagacgattcggagcttattcgtagataaatgatggaagtagcgagatctcatttgtttcttgcgggttagtaaggctaaaagccaaaaaattttgaacaaagcgactcgctcaacgagaacgaaatcgatcttatcttcgttgaggtttgctgtaggtgcgatcgccacaccgccaccgaagtaggggtgatttgtcgttgtgcacaagaaagcctttgtaaaattcaattgtttcccattggtttctaccaggatgggaaatcctttttgccggaataagacattcactactgcagacaagtaggcaaatgaacctaaattgaacttgtttaagtttgatttcgcagcagaatgatttgctgcgtaaacgatcgatgcatctaatccaataccgatattgttgattgcgaacccagtttcatcttggatttgatcatgatacttgatgatcgtaaccgattgaggagtagcggtcccagcgattttccaaaatacttgctctggttccttaggtaaacgcattcctctggcaaagtcattccctgatcctgccggaatgtagcctagtggaatatttttttctgattcttgaagggaggaaactacttgatgtaaggtgccatcgccaccgatcaccaccagtaaggggtaaagcatttctgaattttctcgatagatgtcatcccatggcaacaatacttgtgccagtaaagaagtagtaagttcctgttcttgcccggcatattctgtatagtagaactgatggggaaaacgccgcttcttgacgattgcttcaatttttttggctacttttaggccacgtccactgcctgcttcagggttaacaacaaaatgataataatatttcatacaataaatgctccatctaatctaaaatcaatgctgtttattatagcacgattgctgacaagtttggctagtgatgcttaactattttttgacaaaaaaatagattcgacgaaaggtacgtaacaacaagctactattttcgctgttgtttttgtgatctaaggttcttatgtccactatgatcacatccgtattgctcacattcgccgaatcctattcaattagtaaggagtaactcaaattcccacatcctttgtctgtttttctaagttgacaacaattcttttcttgcagatccttcatcgtctgctttactgggaatccttgctccttacacttatagtatagcacgaaaacggatagaagcaaccgcttacatggtctttgtcactatctttagataaatttaaagatatcaaaagacagcactcttgaacttattagccattaagtcgatgaacaatgaaggtgtacgattcccctcataagcaaacaggaacttagaggaaaatgaacaattgaacgattcacagacatcaagtttacatgaagttggtttgacgaataaagagacggatgtccgtctctttgagttctttatccaagtttattcaatatagctgatggaacatcattaggcgagacttcttcccatcccattactcctttatgattatttacatgtaatacaaggtatgcattctcttttagtggcttgtctccataggaattaaaagacacatctttttcattattgtctgatgtatagctagctaagttgtactgtatctaaagtgttctctcccgctacctctaccaatcgaaacgcgttcacctttcgaagttatcttagtgtagtaatctgtcgttccataagattgctcataccagaaccagcctccacccatcagaagaagggttactacagtaaaagataatagttttttcatataaaatcattcctttcgaggaatagattacatctatgaataatgaaataaatcaatctaaaggctgagaataagcaaacaaaattgtaaggaggacaatgagaattagtaggagaggaagaacagaatgaattgcgagcaaataaatactcaatgctcgtctttggcctattttgctggaagattcctattcaaagcagaaccaccgttttaatggttatgtatttaaaatattctagtcatttccggtatcttttttagcctcgctgatagatagatcgttcctctttctttttttgttgattttaacactttgctatttgacaagtgggttgctttagaaggagattgtacgaccttgttactgaagaacagcttgggggaaaataggtttttagactttcatccacaaaacatccacatgaattctccaatttaattggacaatggaaatcaataagaaccaaatcaataatgtaagcttgataaatcagtaatcttctgtataataattatttgtgcgtaacgcatcgcggttcatcaaccatcccgcgtaatcaaaactcggagaaagaagggatcaaatggataaatcatccactttatcaaaccagcggttgcgagttgtcgtcgcgaacggtttgatcatggcactgtatgttgcagtgacagtcttagtcgccccagtggcttctggtgccattcaatttcgtgtctcagaagggctgaatcatctggtagtctttaacagaaaactgatgtggggtgtttttggcggagttgtattgtacaatttattttttggtatgggaattttggacgtcgtctttggtggaggccaaaccttgcttgcattgtcagcaacggcgctattgcagaagaaagttccgaatgtctttgtccgtttagcgcttaatacgattttcttctcgttgagcatgttcttgattgcaatcatgctgcatctgactctcgcattaccattttgggcgacctttggtacaacagcgctaagtgagttgattatcatgacaatcacagcgcctataatgtatatcgtgaatacaggtgttcgcttcgataagcgattttaatcaatcatttgttttttgctttgatggttcccaaaaaacaaataaaaaaagatcatctctaccaaaacctacggtagagatgatcttttttgttattctgcattcaaatcttcaatttcaacaactttgaagttttttgcctctaactgataaatgatcttatcgcacagctcttttgacgtattcgctggtaaagtaatcaatgtccgacgaataaattcatccttgccgatgtccaatgtgatacagctggcaatactgctgtatttcgcgatgatttttgaaatgatcgctaagtcaccttgtgtgccagttgatgcgatagtcagcacgtagctaccttgttcgacattccaagattgagacagcatattcaataatgaactgtgggtcaaaatcccatagaactcattgttttcatctaatacggcaatgtatggcaattctttgatcgtgaaaaagactttaaaaaatgaagaattgacataaataaattttgtcgcgtttttaagcaggtgtgtcactggtaatgtcatatctccaccattcgatttgtgacgatagatgtgcattttatagatgtttccccggaagattttgccggattcatctaagatcggtacacagcgatagccagaatcttctaaaatttccaaggcttcttctaaagtagctgtttctttaatcgtagttaagtcgcgttttttgtaaaccattgtttttagtaacataacaattccctcccaaatacccaattcacatctctataataccataaaatcagcggaaactatatttttgcgtgtcaaaatctaaaattgacactttcactgaaaaatggtatttttaactttggaaaactttgtataaagggggaggacatcagaaatggcaacaaaaaaagcagctttggcttgttctgtctgcggatcccgcaactattcgaaatcagtcagtgaaggaaaaaaaggcgatcgccttgaaattaacaaattttgcaaatactgcaatcaatacacgctacatcgtgaaacgaagtaaggaggaatcttgatgaactttatgaaaaatgtttttgctgaaatgaaaaatgtttcttggccatcaagaaagcaattacgcagagatacttttgttgtgatccaaacgacaattatttttgcagtgatgttttttgtgatggatacgctgattcaaactgtttttgatttgattttgaaataaatgctgctggattatcagcaactagtcaagtaaaacaaatcgtggtataattgattcgaggaaaaacttcggtgcaactgaggtttttttattttacaaaaagatagggagaccgaatacaatggaatcttttgaaaaaaattggtatgtcttgcatacttactccggctatgaaaacaaggtgaaagcgaacttggaatcacgggcgcaaagcatggggatgggcgattacatctttcgtgttgtcgtaccagaagaagtcgaaacggaagaaaagaatgggaaaaagaaagagatcgttcacaaaacttttccaggttatgtcctcgtcgaaatggtcatgacggatcaatcatggtatgttgttcgtaatacaccaggagtgactgggtttgtcggctctcatggagcaggaagcaaaccagctccgcttttacaagaagaaatcaactctatcttacgttcaatcggtatgagcactcgaacagttgaattggaagtggagattggtgaaacagttaaaatcattgaaggtgcattctctggattagaaggacaagtcgctgagatcgacgaagaaaaacaaaaattaaaagtcaatattgatatgtttggtcgagaaacaagtacagaattggattttgaacaagtagataaaatctaagtataaaactgtagtgttttttgtcaaaataaggtaaaataaaattgaaaattggtgatagcggaccgttattggcccgctgtttttatctcacgaaaagaaagcgttttataaaaagggggtactatgaagaaaattctcgcatcgatttgtcaacgccatttttttgatcaacatttggaaaaaagaggtgtgatttccgtacataatggttatagtttgttgtttgcttttaatttgtttttgctgctttctgccgtgatctttatggaacctcaaaaagtgtttcgtgaaatgcttacaatcatgttctcggaaagccatttagtaacggattacgttgcgctgacttctgtaggtggcgcactgttcaatgcgtcgatcatgacttttgttgcgatcgcggtctgttaccattaccgagttccggttactggaggaatgatatcagccgtcttcatggttacggggtatggtttgtttggcaaaaatctgttcaattttattccaatcttcttaggtgttcgtctctattcctatttaatgaatcaacccctcaaaaaatatcttctcattgctttgtacggttcctccgtttcacccatcgttagtttttttgcattcaatgactcacttccagcttatttcggtagcttcatcggttatttgatcggtgttttgactggattgatcatggttcctttagcactgcattttcaagcattatttaaaaaagtcagtatctatagtgccggctttacttctggcatgttgtgtacgatggttgcaggaatttgccgaatgtttggttttgatatcgaattgcgagcaatcgtttctaaaggctccaatcttccactggttattatgatggtgtcgctgtctttattaatgattggctatgggttagcaatggctgttaaacgcaagcggttgaacatgcgggcaatatggtctcatagcggcaaaatcgaatacgatattttacgtgaaagtggcgtttataatacgatgattaatatggggttaatgggattgctgttaatgagttatgtgagtatgctaggtgtcaatctcaatggtcccattgcaggtgcgatgttttgtgtcattggtttttctgcttgtggtgcccatgtctttaacgcgctgcccttatttgccggtgtgctattagcaaatacaatgaatatctacgcaatgactgaaacagtaaccgttacagcggctatttttgcaatgatgctctgtgcggtgactaatgcttacgggtggaaaggggggatgatcgtgggattcattcatacgtcgatggttttgaatatcgatgtgcttcatggtggattgaatctgtacaataatggcttttccggagggctcgttgcgatgatgatcattccattgctcgattttttttcacaaatcgcggacacctcgatttttaaacggaagaaacagtccggaggcaaagaaaaggtaacctaccaagcaacgagtaaagaatgaagtgttcttgaataaagagtaaacattagctattgcttgtttcttgtttcaaaagggattatactagacccgatttggagggactgtaaatgaaaaaatggctatttctatgtctggttgttttgcttagcggctgtcaagcagcaactcactcaaatgtttcagcacaaaaaagtacacagaagccaacggagacaacgactgcttcggcagaaacatcaaccaccgaacccgttcagaaaacgaccacgccaacactctttattcatggttatcaaggaggtcccgcatcatttggagggatgatacagcgttttgcccaaaaagattgggtgagcaatgaaatggttctaacaatttcaccagatgggacagtttcaacggaaggagtgctttctaaaaaagctgtaaatccaaccattcaggtcttgttcgctgacaatcaaaataatgaatggaatcaagcagaatggatccgacaagcgttgctttatctgaaaaaggaaggaatagagcaagtaaatttagtcggacattccatggggggagttagtggttttcgctatctcacaacatttggagagctgagtgcagctggggctgaagcactggatcccgcattgccaaaagtagctaaatttatagcgatcggggcgcctttcaatgaatttattgatacgagttcacgacagactatcactgatttagtgacaaacggaccaacggaggcttctccacgctaccaggaatttcaaggactattgaagcaaggggggcatcgactcccgattgagctgattgctgggcaattatctgatgaagagctatcggacggcactgtgccgaccacaagtgccttggcgatcaaccatttattggcagcgaatggctattctgtgactgaaaaaatcattaaaggatcacaggcacagcatagtcagctgcatgaaaatcaagaagtagatgaagacattgctgcttttttatgggagaaataactgatagtcgtcaaaaagctgtaagaataactttgatataagttctatctgtttttttagtagtagcaaatagataaaaatatccgaatgatcggagatcgcttattcttctcgtgcataagtaacgaggacctgcagagccgcgggtgctatctaatgatcattcggatatgttatttgttgagactcttacatcttttagtgttcagcggcatctaaaatttgcgcttgtagacgttgtgctgtaggcgttgtggccaacccgccctcggctgtttctttaaaaatacttggcatttgccgtcctacttggtacatcgcgtggacgacctcatccggaggaatcacactttcgattcctgctaaagccatatcagcagaaataaatgtttgtgaggaaccgagagcatttcgcttcacgcaaggaacttcgactaacccagcgacaggatcacaaatcaatcccatcatattctttagtgtaatggctactgcttgagcagcttgatgtccgctcccacccttagcacagacgagggctgctgctgccatggcactggcagaaccaacctccgcttgacaaccgccttctgctccggatatcgaagcattgttcgcaatgactagtccgaaggctccggcagtaaagaggaaatcgatttgttgagaacgagacagctgcaaacgatcgcgaacagccatcagcacaccagagacaacaccggcactcccagctgtaggagtggcacaaatcaatcccattttggcattgacttcattgacagcaatggcattttgaacggcttgcaagatcgtctcaccacttagaaaatcaccagcctgtatataatcattcattcgtgtggcatcgccaccggttaatcccgtcacagaggtcactccagcaacgccctcggcaacggattgttccatgaccgtcaggtttttgtccattagtgcaatgacttgctcgcgagtgcgccctgagttttcgcattcgaccgcaatcatcatctctgcaatcgatgcataatttttgctttgaagaacaagatcttcaatcgtataaaacatgacgaatcctcctttaatcgaaataagccgcactataaacgtggggcagtgctttgatttgttgtgccaattgatcatttcgttcatccacttcaatgatcataatggctttttctcctttggactctcgggtaacagtcatcgtaccaatattgatttgtgcctcagaaagtagattcgtgacacgtgcgaccattccgggaacatcttgatgaacgatgacataggtaggggtacctaaagtcaatgagattttaaaaccattcaattcagaaatttgtatattcccaccgccgattgaaatgccggtaacggacattttgcggtcacctttttttaaaatcattttgaccatattcggatgttcggctttttcgtttttcggaacaaagagtacttctagaccttgctcataggctaactttaatgagtcagcaaggcgctgatcatcgggctccattcctaacaaaccgccgacaagtgcaatatctgttccgtggccgcgataagttttcgcgaaggactcatacaaaaggatatcgacactgtcaggctgttcgccaaagatgtggcgcacgattttgccaattcgagcagcacctgcggtatgggaactgctgggtccaaccataattggtccaataatatcaaagacacttcggtattttaaaggttccattctattcacctcatttaattgatgggagaaatccagatgtagtttagcataaaatatggagaaatagagcaatgagtggaactgtatgggatttttttaatcttttttttgttttaccgattttctccataaaaagcaaaaaaattcgctaagagttcttgcaaatttcttttgagatgctataatatctcagtgtgcattattcacacgttttttgtgtgcgcacatgattcactaaagtgggaggagaaatatggatctccaattaaccacatcacggactcaaggaggtatgtctcgtggcaaaaaaagtagaaaaaatcgttaaattgcaaattcctgcaggtaaagcaacaccagctccgccagtaggtcctgcactaggtcaagcgggtatcaatatcatgggattcacaaaagaattcaatgcacgtacagctgatcaagcaggcttgatcattccagtagtgatctctgtatacgaagaccgttcattcacattcgttacaaaaacaccaccagcagcagtattgttgaaaaaagcagcaaacgttgaaaaaggttcaggcgaaccaaacaaaaacaaagttgcaaaagtttcacgcgatcaagtaaaagaaatcgctgaattgaaaatggaagacctaaacgcagctgacgttgaagcagctatgcgcatggttgaaggaactgcacgaagcatggggatcactgtagaataatttttacagaccctaaggaagtagcttctcagtcggctctatattgaaaaatatgggacacgtgggaggttctaccgttataaccacatcaaggaggaaacaaaatggctaaaaaaagcaaaaaaatgcaagaagcattgaaaaaagttgacgctgcaaaagcttattcagttgaagaagcagtagctttggcaaaagaaacaaatattgcaaaattcgacgcaacggttgaagttgcttacaaactaaatgtcgatcctaaaaaagcggaccaacaaatccgtggtgcggtcgtactaccaaacggtactggtaaaacacaaacagtgttagtttttgcgaaaggtgaaaaagccaaagaagcagaagcagctggtgctgatttcgttggagacgatgacatggttcaaaaaatccaaggcggatggttcgattttgatgttgttgttgcaacaccagatatgatggcaactgtcggtaaacttggtcgtgttttaggtcctaaaggtttaatgccaaaccctaaaactggtacagttacaatggacgtaacaaaagctgttaacgaagtaaaagctggtaaagtgacttaccgtgttgacaaagctggtaacgttcatgtaccaatcggtaaagtttcatttgaagatgacaaattagttgaaaacttcaaaacaatccacgaaactttagtaaaagctaaaccatctgcagcgaaaggtcaatacatgaaaaacattactgtaacgacaactttcggacctggtatccatgtagatcaagcttctttctaatttgaataaaaaacaaaacttttgttgacttgactgccttatctatggtaaggtagtcaaggttaaaagtttaactgtaccgaagacagtaggtgacgtcagtcttaatttcctaccgaggacgtttattgagaaacttcaatagtccctctatgtctacggtggcatagagtttttttgtttttatctcttgataaagacaaatgaagacagaaatgttttcttgaaactcttccatcaaaatcaggaggtgaaatttaaaatgagtgaagcagctatcgctaaaaaagccgcaattgtggatgaagtgagtgaaaaattcaaagcagccgcatctgtagtagtcgttgactaccgtggattgactgttgacgaagtaactcgtctacgtaaacaattacgcgacgcaaacgttgaaatgaaagttatcaaaaattctatcctttcacgtgctgctgaacaagctggtctagaaggtcttggtgaagtattcactggcccaactgctgtagcgttcagtaacgaagacgttgtcgcacctgcaaaaatcatgaacgattttgctaaagaggctaaagcattagaaatcaaaggcggtatcatcgaaggcaaagtttcttctttggaagaaatcacagcattggcaaaattgccaaaccgcgaaggacttctttcaatgttgctatctgtgctacaagcacctatccgcaacgtggcttacgctgtcaaagcagtggccgaaaaagaagaagatgcagcataattgccgcataatcacactataaactaaactatctaattaaatggaggaaaacaaaatggcattgaacattgaaaacattgtcgaagagctaaaaggcgcgacaatcttagaattaaacgacttaattaaagctatcgaagaagaatttggcgtatctgctgctgctcctgtagctgtagctggtggagctggcgacgctggtgctgctgaagaacaaactgaattcactgtagaattgactgcagctggcgaccaaaaagttaaagttatcaaagcagttcgtgaagcaactggtttaggcttgaaagaagctaaagctgtagttgacggagctccttcagcagttaaagaaggcatctctaaagacgaagctgaagcattgaaagctgctttagaagaagttggcgcttcagtaacagttaaataatcatttttgatttttttgagctagaattccttttaagtaagggttctagctctttttttgtttatgattctaatttcagtttgagaaaatgacgctgtcttactattagtgatccgtatttttgttgaggcgtcgaggactttttataaaaaaacaagcctaagactagcgctgagcgccgctgacttaggcttgtttattttttgcgaaattgctgaacaagaaaaatgaagataaaaaagaataatgcttcccataaagtagttgtccaactaaaggtacgactgatcccaaaaaaaagattcccaatattggatacgaccaaatagatgaccgtagcaatcaatgaaaaaattaagcgttttgccatcataattcccccttgcctttgattgtaacaattgactgacgagagagcaattattttaagaaaaggctcctgtcaaaacgaaaaaaagatgcgccattctttaattgttttgggtgctttcaggcgtgagagcaaagaggggagctctataaatttttttgattttcccaatcagttcattgattaatcaagaggaacatcaaaaatccagccagctggagccttgcgctcaccaaattggatacccgtcaattcatcgtatagcgcacgagttttaggaccgacctccgtttcactgtaaaacacatggaaagactctccattttggattccgccaataggtgaaataaccgcagcggttccacaagcgcctgcttcaacaaagcgatccagttgatccacatacacatctccttcgacaggtgttaatcctaaagcatgttctgcaagataaaggagagaatatttggtgatactaggcaaaattgatggcgattttggtgtcacgaattcattttcggccgtgatcccaaagaagttagcggaccccacttcctcaatttttgtatgtgtttcagggtctaaataaatgcaatctgaaaaattccgttcatgggcttcgtatcctggtaataagctggcagcataatttccgcctacttttgcagcgccggtaccatttggtgctgcacggtcataatctgaaacaataaagttcgttggggccagctcgcctttgaaatatgatccgaccggcatgcaaaaaataataaacaagtattctggcgcaggtgcaacgccgatattctcgcctacaccaatcaatagcggccgtaaatatagagtagccccggtaccgtaaggcggtacaaattcttggtttgctttgaccacttgattgaccgcatcgaggaacatctcttcgggaacgaacggcatacgcaagcgacgagcgcttcgattcaatcgtttactattctcatctggacgaaacaagttgatcccgccatctggtcgtcgatacgccttcaagccttcaaagcattgttgaccgtaatgcaatgctggagaaccttcatgaatatgcagaatattatcttcagtcaatgctccttgttcccaagagccatttttccattttgcgacaaagcgccaaggggttttaatatacgaaaaccctaaattttcccaatcgatttgcatagagtcacttccttttttaatttttcctagtatagcatggaacgcccatcaagtcattattttctgaaaattcatcgcaatgattttcatttctaacatcatgatgaaagcttattactagagactttatattcacagaattttttttcaagcctatctggagctctgcagttgttgataaaaagggggaaggattttggcagaacgtcgagcactttagattgtatttacggaacagatatgcttcaataagggtagaaaaaaatcgattaggaggactttcggtgatcaaagaagcggtttctgaaatccaaggtgtcctggatgcttatcagcgactggcaccaatcatgatccatacacctgccgcaccaagcaatattcttagcgcagaaaaggcaggagaaatttatctgaaactagagaatctgcagcgtacaggatcctttaaggcgcgaggggcctacaacaaattagcaacattgacagaggaagagaaaaaaagaggggtaattgcttgttcagcaggtaatcatgcgcaaggtgttgcactagcaggcgccctgctagggatacatgtacggatctttatgccgcttcaagcagcgaagacaaaaatagaagcaacgagaaattatggcgctgaagtgatcttagcaggagagacattcgacgatacaaaacaaattactttggaagcgatgtcacgtagcggtgaggtctttgtctccccctttgatgatcgagcggtaatggaagggcaaggaacgattgggttagagattttacaagatttgcctaatgtggataatgtcatcgtaccgatcggtggaggcggcttgatcgcaggcattgcgttagcaatcaaacaattacgctcggaaactaatattattggtgttcaatcttatcaagtacatgggatgatttcctctatatggcgacaagaactgatagccaatcgcagcagtaagacattggcagatgggtgcgatgtggctttggctggagaattgacttatgaaacgttgcgctcgcgcatagatgaaaccgttttagttgaagagaaagatatcgaaactgccatccattatttggctttaaaagaaaaagtgattgctgaaggggcaggtgctctgagtacggctgctatcctaagcggacaaatcgatcatttgctgaaaggcaaacgaacagtcgcaatcgtttcaggcgggaatatcgatttctctgtttttaaagaaatcatttaaaaaaagatgatctcagaccaactagtcgtctgaagatcatcttttttagtccgttttcgatccagttttcagaggagaagaaacgtttactaaaaactgcgaccgccgccgccaaatgttccgccgccggaagaatgagtagtggtgccaccgccaaaaccgccgccgccattatttttaggtggacgtgggattcggcgagtcgttacgaaggagttgaccagacgatcttctttttgagtcaatttgatgctggatttttcttggtaagggtatttgtatccacccatttttaattggtatcttgatttgacaatgatgaaaaaagcaatactgatcactgcagctaccaataagctaatgccgatttctaaaggggtcagcactttataataagtgatcttgcctgtctcacgatccacatgatagtgaccgccgggaacccccgcttctacatagctggctgcattctccaagtagacccgggcggcttgatagtaattacccgccgtcatctgatcataaatattatccaacatatcatcaagacgagcgtcgttgatataatcgagcatatttcctgaggtggacacatgaagattacggttgcccatatcgatcatcaatgccgagccattctgatcatttccgatgcgatcggcgagaaaacggtcggtggtatattcaatatcgtcaattttgttatttgtcgttgcgataaaaacttcacctttgattttctcattcaactgatcggcttgttcgctcaaactctggatttcggagggagtaaaaagaccagcgttatcagtaacggtattttctgctgccacgccagtgaccgtcgtcagtagaaatccggcaaccattaggaaaaaacaggaaaattttctcataggaaatatcctccaatcatccctagaatcgcaatcacagcaaaaatcgctgcactcgtaaatcctaagcgtttgtaactgatgggcaagacaccgctgactttaccggtttggccattcatcgcataataaaaagcattcttattcggatcatctgcccgataagtgaccagccagactggtagtaggacgtaatgattggtttctttcgtgatctcaatgtcccgctgggtccgattgaagcttgtataaccattaacggtactgcttaggagattttcagcataaccggaaagttcctgttgtacttcattcttaagtgcttgatactcaatgtcgcgtttttctgcttgaaatcctgccagatactggctgcgaaagtcaacggccttatccaatgggaaaggctggaccccggtaaccattttttgttggacattcttggataaagcgtttttgatcagttcattgatacgcatttttccgcgtctggaaacagcaaattgtttgtgttctgtatattcgatctcgccgacacgccaaattcttaaagaagttccagttccagatagttggccatctagttcggcatcgatcctccagtaggggaaataaacaccggtcaatttttcaacttgcgcttgatcgaagaagtctcttggtacgaaccattttttttgtgcccattccagaaatttagcggttgcttcttctttttcgattgcaaaaggtaaaactttgttaggtaagaattctccagaaagacggccggaaaggacgactggattgtggcagaaataacagtaagtagctgctgtcgtagcatcagtgacgatctctgcgccgcagttaggacaaaggaacaagtccatttgggccgccttttcttcggttttttctgtgatagcttcttttagcgccggttccgtatcatcagtgatcggctgattttccggcgcagtcccatctgcaagttgggcttctttttgtttttgttcaaaggctgttacttctgcttctgtaaaaatactcaaacagaaggggcagtggaatttttgatcaccaggatcaaaggttagcgcaccgccgcagttggggcatttatgcgtaatgacatccatttaagttcctccttcatttagtctaaaggaactcccttaaatggcttgccgcagttgggacagaatttcgggattccatttgctaaatcaattatttcactacattctgaacatttcatttgtaaacttggggttcctgtaggttttgctgtaccgcaattgctgcagaacttacccgtattgcttgttccacactgagggcagtcccaactatcgccattgttttgtttctgctgattttcttggttttgctggatttgttgctgattgttttgagctgcttgattcaagtaaccgccagttgtgttcatccccatgcccataccaacaaatccggttgttgcaccggcagcattactacctgcggattccatcccacgtgcgatcgaaccttgaacatacccttcacgaacatttgggtcacccaacatggcaccttgattacgcatgttgatcagtttcactgaatcatccgtataagagatgcttgcaacagcgactgaaacgatttccattcctcgcagttcgcgccaactgtcgtctaaaacctcacccatgtatttgcttaattccatactttttgatggaacataggagatgcgctcgccatccgctgacattttgttgatggctgtctgtaaagcagtcagaaactctgctaaatattgttcgttaatgtcattgatgtcaacttgtgttttattttttggaatcgcgttggtgtagaataagatcggatcagtaattcgcaatgagtaatttccatgggctcttaggaataattctgcattataaaagttgtcaaaataatttaatggagaagaagtcccgaagcggattcctttgatttcttgcaaattgatatagaaaacttgttgtttttgaggtgttacgccaccaaatttgaagcgattaaacgtttcagagatggcatcctttaaggaaccgttgaacatggaaggagccaagtcatttttgacagtatagtagccttcctctgctgtataatcaatgatttttccaccatcgaccagcagcatcatcatattagggtagacgtggattacagatccatctgttatgacatcctccgttccttttcggttcgaaccgcgtttgtcattgcgccgtaccttcacacctttagtcatcactgtcgtgtcgcccatattgtcaggttcgaagacctctagccattggtcggcaagacctccgccaatcgtgcttgttgcagctttgataatacccattttcagtcctccttacaaattttcatcatccaatggatgaatgtacattcattataccatagctccgtattttctatgtattagaccaaagttgtagaagtgtaggcaaaagttgaataaaaaatcgtctataaaacaatacttttttcaaagtatcgttctctaggatgtgcggatttttattaaaagattgctcccttaaaaaatcatttctttttcagcagataggcaactcaaggtagttttttttgtaaatattacgtataatagataatagcgaattttgaaaagagtgaggaaaaatatggcctatcaagcattgtaccgtgtatggcgatcccaacggttcgaggatgtcgttggacaaaaagcaattacgcaaaccttgaaaaatgcgatcgagcaaaatcaaatttcgcatgcttatttatttaccggtcctcggggaacaggaaaaacgagtgctgccaaaatctttgcaaaagcaatcaattgtccaaaccaagtcaatggagagccctgcaatgaatgcgagatgtgccgttcgatcacagctggtacgcaagaagacgttatcgaaatcgacgcagccagcaacaatggggtcgaagagatccgctttatccgagaccgtgcaaattatgcaccaacacaagctgaatataaagtatatatcgtggatgaagttcatatgttgtcgaccggcgccttcaacgcgttactgaagacgttagaagaaccacgaaaaaatgtagtgtttattttggcgacgacagagccgcacaagattcctgcaacgatcatttctcgaacgcaacgatttgattttaagcgaatcaatacgcaagatatcgttgatcatctaaagacagttttagacggcagtcaaattgcctatgaagaagaagccttgcaagtgatcgcacgagccgcagaaggtgggatgcgggatgcgttaagtatcgctgaccaagctattgcctttagtgatggcaaagtcacgactcaagacgcattagaagtaaccggcagtttgtcttatgagatgatggaccgtttgatgcaattttgcgaagaccaagcagtaccagatgcattagagacattgcgccagctgctgtcttcgggcaaagaagcacggcggttgttggagaacttgctggtctattgtcgtgacttgctcttatatcagcaggcaccacaattattagaagaaaaatcactgcagatcacaccaggcttcaaaactttagctcaggcagctactgcagatcaaatctaccattggatcactgttttgaatgagacgcaaaacgaggtgcgatttaccaataatccgaccatttatttggaagtagcagttgttaaactagcaaatcagaggagattgccagcttcaggagaagtttcggtgtcgaatcaagaagttcagcagcttcgtcaagaaattcagaagctgcagtcagaagtacgaaaactacaagaaaacccatcggcggccagcagtgaaccggtcaatccacctgccaagaagaccagaaatagcagcactttccgagtgccgaaagaacgggtctttcaagtcttgaaagaagccacaaaaaaagatctcgcaaatgtgcggaacatttgggatgatctgttgatgtcattgtcggtgacacaacgagcaatgctccacgcgagcgaagcaaaagcagccagtgcatctggtgtagtgattgcctttgattatgagattgtctgtcaacgagcagccaatgaccaagacttgcagctgacattgcataatcaaatttcacgaatgatatctgattatgcaccgcaagccgtgtttatcacgaaagaaagctggccaatcttacgacaagaatttattgctggcggacaaaccttcaatacaggcgaattagatgaaggggaagctgaaccagaaccaactacggaagaacctgaaaatgaagtcgtcgttaccaaagcccaagagctttttggtgaattggcgagcatcgaagaaaattgagagaattggagtgaagaacaatgatgcgaggcatgggaaatatgcaaggcatgatgaagcaagtacaaaaaatgcaaaaagagatggtaaaagaacaagaagccctaaacagtaaagaatttatcggcgagtcaacaaatggctatgtgaaggcaacttttacaggtgataaaaaattacgcgatctttcgatcgatcaagcaatcgtcgatccggaagatgttgacatgttacaagatatgctgatcttggcagtaaatgatggattaactaaaattgaaaaagaaaccgaacggactatgggtaaatacactaaaggaatccccggtttataaaaggagaaatgtggcgtgcagtatccagaaccgatcgcacgattaatcgacagctacatgaagctgccaggtatcggacaaaaaacagcaactagattggctttttatacgatcgatatgaaagatgaagtcgtcaatgagtttgctaaatcactgttgagcgtcaaacgtgatctgcatttttgcagtatttgcggaaacattacagaaggagatccctgtgagatctgcagtgacccttcacgagataaaggcacgatcttagtagtagaagaaccaaaggatgtcatggcgttagaaaaagtccgtgagtaccatgggctctatcatgttttgcatggtgttctgtctccaatggaaggtactggaccagaagatatcaatattgctcctttgattcagcgtctgcatgatgaccaagtgaaagaagtgatcattgctacgaacgccacgacagaaggtgaagctaccgcgatctatctttcccgactgatcaaaccagcggggatcaaagtgacgcggttggctcacggtttatctgtcggcagcgatattgaatatgcggacgaagtgacattgcttaaagcagtggaaggaagacgtgaattataagaaattggaggcaacaagggtgagtggactgttcataaccattgaaggaccagatggcgctggcaaaaccagtgttttagaagaactatatcctcgtttgcagctagaagccaaacgagacattgttaaaacgagagaaccaggcggtgtaaaaatcgcagaaaaaattcggcggatcatactggatcccaaaaattctgagatggatgaacggactgaagcattgctgtatgctgctgcaagacgccaacatttgatccaagtgattttaccagcattgaatgaaggcaaaatcgtgatctgtgatcgatttgtagatagttctttagcttatcaaggggcagggcgccggatcggtattcctgagattgcacgtatcaatgaatttgccaccgaaggcacggagcctgacttcactttgtatttggatgtcgattcggatacaggtttaagaaggattcaagagcatcgggctcatcagttggatcgcttggacgcggaaggattagaatttcaccaacgagttcgtcatgcttatttgaagctggcagaagaaaatcctgtacgcatccataaggttgatgctagaatgggattacaagatgtcgttgagacaagtttttcagcaatcgttgaagcatatccttcctacttcaaaacaatgtgatcgctgacgacaataataaggagatgatctcatgaaattgattatggcaatcgtgcaagacaaagacagcaaccgattagcaaatgaattcattgatgccaacattcgcgctacgaaactttcatctaccggcggattcttaaaagccggcaacagtacatttattattggtcttgaggatgagcgggtccaagacgcattggaactgatcaagaaaacctgtcagtctagaaaacaatatgtttccacaccaatgtcgttagacatctcacttgatgggcaagtaccttatccagtggaagtagaagttggcggtgcaacggtttttgttctaccagtcgatggcttccatcaatactaaaaaggagcagaccatggaggaactttttttacaagaatatcaacctctggtttttgcccaactgaagaaaagtgtcgagcatgggcggattgcccatgcttatctttttgaaggcgatgcaggaacgggcaaacatgagatgagtttgtggctggcgaaacgtctcttttgtacgaatgttcaatcagatgaaccttgcggatcttgcagtaattgtttgcggatcgctcaaggggagcacccggacgtactcatggtggaaccagatggacagacgatcaaagtagatcaaattcgtcaattgcaagaagaattttctaagagcggcttcgaaagtcgcttgaaaatctttcttctttctcaatcagaaaaaatgaatacaagtgcagcaaatagtttactgaaatttttggaagaacctgtagggaatttcttagcgattttagaaacggaaagtgttggacggatcttgccgacgatccagtcccgttgtcaaatcattcatttttcaccattggcgaaagaaaaattgcagacaaagctgcaaaaagaaggactttctcaagagagtagccgtcttttgagttacttgacaaatagttatcataaagcagttgaaatctcccaagaggaatggtttaatgaaactaaggatgctgttgcacaatgggtgaagtatctcttgaagaaagatccgcaagcgtttattttcgttcaaaaaaagctgctcgctttagcaaaagaaaaagaacagcagagagttattttttcgattctgttattttattttcaggaagaacgagaccagttattggcacaaggcttatggggaaaagagatcaatcttgccatcgaagctgccttgcaagcccaaaagaaactgcaagcgaatgtagcttttcaaggcgttgctgaacaattttcagtgaagatcatctatgacataacagtaccctaaagggggagcaatgttatgatagaagtagtcggtgtacgctttcgcgctgcgggacaaatctatttttatgcgcctgagaagcgagattacacgtcgggggaacgagtgatcgttgaatcacaagaagcaaagtttatggcgaccgtcgcgattcctaagcagttgatcgattcgcaagatttgccttatgacataaagccaatcattagacaggccacgcctaaagatatcgagaaagaaaagaaaaatcgtcaagatgctgaagaagcgctgatcattggcaagcagaagattcgagcgcacaatttacctatgaaacttgttagggcagaatatacatttgagcggtcaaagatgctgtattattttacagcggatggtcgagttgatttccgcgaactagtcaaagatttggcgagtcattttcatacaaggatcgagttgcgacaaatcggtatacgagatgaagcaaaggcgatcggcggaattggtccatgcggccgcaagctctgctgttcgacgttcttaggcgattttatccctgtctcgatcaaaatggccaaagatcaagggctgtctttgaatccgacgaaaatttccgggttgtgtggtcgtttgatgtgctgtttgaagtatgagaatgatgaatatgaacaagcaaaacgagaattaccggatcgcggcaaagaagttgagactccggatggaaaaggaaaagtagtcggtctggatttattgcagcgcattatcaaagtccgtttgtacgatcgacaaacgcccatagactatgaatatgaagaactagtgacaaaataagtaggtgaccataatgagcatggacaagcgatcgatttatgatggattgaatcagttagaaaatgaactgcaaaattcgttgaataacttagcagagatgaaacagtctttgcaagaaatcgttgaaaaaaatacgacgctagaattagaaaatcaacgtttacgggaacatatccgtgaattgaatcaagtggccgaagcgcccgcagaatcggtcaaacaagaattgtccaaatcgcgaatgaatttggaaaagatatacgaagaaggattccatgtttgttatgacttatatggatctagaagagaacatgatgaaccgtgtgctttttgtcttgaagtgatctatcgagaaagcggacgataataggaaatgaccagcgcaggtggctggtctttttttgaaagtagggaaagtatgcagaaacaacaaagctataaacaatcgaatggaacgctttatttagtgccgacaccaatcggaaatttggaagacatgaccgttcgttgtgtcaaaattttaggggaatccgatttgattgccagcgaagatactaggaatacccagaaattattgaaccattttgaaataacgacaccgcaacgaagtttgcatgaacacaatttcaaggaacgtgtgccgcaactcatcgatcaattgctagctggaaaaataattgcacaatgtagtgacgcagggatgccatcgatcagtgatcctggtcatgaattagtcaaagcgtgcattgcagctgatattccagtgattgccttgcctggtcctacagcaggattgactgctttgatcgcttctggtttgtctccgcagcccaatcttttttatggcttcttacctcgaaaaaagaaggagcaaaaagaagcattggctgagctggcgaaccagccggctacgatgatcttttatgaatcaccttaccgcttggcagcgacgatcgaaaatatgattactgtttttggtgcagaacgttctgcagtcatctgtcgagagttgtcaaaaatccacgaggaatacttgcgaggttctttaaaggaactgttggactatctaggggaaaatacagtcaaaggagagtgctgccttttggttgagggatcgacggactctgtcgaaatcgtttatgatggaagccttaaagagcaagtaacagctctgatggagaccgggatgtcttctaaggaggctatcaaggaagtggcgaaacgcaatcaagtaaaaaaacaaacggtctatcatgcctatcacttagacgcttaaccgatgcctgtgcatcggtttttttgaataatgagtttcatttttagtggcatggatgattgggtgaaaccgtcacaaaaggacatgatatactagtttaaaaaggagaaaaagatgaacatacgagacatgcaaaaagcgatctatcaaaacaaaattgatcatcaatttaatgtcaccaatattgaaaaggaatttttgtcattatatggtgaagtggctgaagcttttgatgcttatcgcaaaaaacaaaatgtgggggaagaattggcagatgtagccatctaccttctcggtttagcggagatcttatcgattgatctagacggagagattcagaaaaaaatgaaaatcaaccaagcccaccgctataccagttatggcaatgggtatgcaaaacgaatcgatgaatgatggttcgtcattcgattgaactgacaatgaattgttaaaggaagtgggaaacgaaatgacaaccaacttaagcatacgtgagctaacagaaaaagatttaaaggaagctgttgaaatgtatattgcagtcttttcagcggagccatggaatgatcaactgaccgttcctcaaattacagaatatgtgtcatccatgatggcgatgaatacttatattggctattttctaacggactcattgaccaatgaaaagatagggtactcgttaggctttattaagccgtggtaccaaggaaaagaatatgtcatcgatacctttttaattgctggcaagcatcaagggaaaggtttcggctctgcttttttagaaaggatcaaagaagagttggtcaaaaaaggcattcccacgatactattagatacagaagaaaagatgccagctgccgatttttataaaaagaatggctttaagcctttgacggataatgtgactttttatgcgtcgttttgatcgccattacccaagaaagccatcagtcgaattgcgaatgttagatttcataacatataaagtgagcttttttcagaataattgcaaaaatttaaaaaaacactagcgatctcctggataagatggtaggatatctaacataaaagggagtgattggaatgggaacaggaaatagtgggtttattttggtttgcagtgggatggtttttttaatgactcctgcgctagcttttttttatggtggattggaaaggcgaaaaaatatcttgaatacaatgatgatggtgatttgcaccatgggactagcttcagttctgtgggtggcggctgggtattcgctttctttcagtggtaccggtgcgtttatcggcaacatcgataagttatttttccagcaagtttccatgacggacggagaagggattcctgaaggattgtttgcggcttttcaaatgatgtttgcactaatcacaacagcgatcattaccggatcagtcgtaggacgaatgcgtttttcagctattttcttatttattggctgctggctgtttttggtttactttccgatggcccatatggtttggggtggcggcttcttagatgctatcggttcgattgattttgcaggaggcaacgttgtccatattagttcaggaatcagcggtctcgtgctagcattagtcgtgggtaagagacgcgagtttcatcaaacggagtatcgtccccataatattccatttgtcgtactaggtgcagggttgctatggtttggctggtttggcttcaatgctggatcagcattagctgctgacgggatcgccattcaagcgttgttaacgaccaatacggcagccgcagctgcgatgctctcctggatgttgattgaaaaagttctattagggaagccaaccattgtcggagcttgtaccggagctgtcgtgggtctggtagcaattactcctggcgcaggttttgtttccctttggtcatcctttgtgatcggggcattagtgagtccgttttgttattactttatttcggtcatcaagcatcgcttaggtctggatgacgctttggatgcttttggttgtcatgggattggcggaatctttggtggaatcatgacggggattttcgctgatcctgctgtcaatcatcaaactgggttgctctatggtggaacagaattgttcattgcgcagatcattagtatcgtatttacgattctttttgcggggggcatatcttttctattgatccatgtgatcaaacgcgtgctaccgatccgggtcacagaacaagaagaagctattggaatggatcgcagtgaacatgatgaaacagcttatccaacgttcatggggctggattcatagatggaggaatgcagatgaaaaaagtagaagcgatcattcgacaagaaaaattagaagaattaaaggcagctcttgatcaaatagatatggctggaatgacggtgagtcaagtattgggctgtggtaatcaaaaaggggtcaaagaatttgttcggggacaagcagtgattacgacacttttgcctaaagtaaaggcgagttttgttgtagaagatgaagaggttgaagcaatcattgaactgattttgtctatctgccatacaggtgaagtaggtgatggtaaaatttttatttacccaatcgaagaagcagtacgaatccgaaccaatgaacgaggcccatcggcgctgtaagtctagacgtttttaacgaatcgaaccaaatttgaagtcttaaatcataacgggaagcaaaaagaatttctgtcttttttacagggattctttttgtttgcaacaatcgccgatgcttagaatgagcctcttgatagggaacttctgttcgtttataatagaggagaatggagtggtgaagatggctgagttgcgttttccgttaaaaaacgatacgtctcggaaaatcatccatatcgatatggatgccttttttgcatcagtagaagaaagagacaatcctgaattggctaagcatcccttagtgattgcccgccacccaagtgatactgggggtagaggtgtcgtcacgactgccaattataaagcacgtcagtatgggatccattctgcaatgagtgcgcaaaaagcctttgaattgtgtcctcatgccgtctttatacctggcaaccatcagaaataccgcgaaatttctcagcaagtccgagagatctttgggcgctataccgatgtgattgaaccggtttctatcgatgaggcttatctggatgtgaccgtcaacaagatcaactgtccttcagcgatcaaaattgctcgcatgatccagcaagacatttggcagacgacccagcttacttgttcagcaggcgtcagctacaataagtttttagccaaattatcttcggattttcacaaaccccgggggttgacggtagtgatgccggaagatgccgtggtctttttaaaaaaattaccgattgacaaatttcatggtatcggtaagaagacagtgccgagaatgcacgaattagggatttataaaggatctgacctttatgaatggagcgaaatggcattgatccaagaatttggaaaaatgggctactcgttataccggaaagttcgaggaatccatgattctccggtcagtgtgacgagagaacgcaaatcagtcggaaaagaacatacgtatggcaatgcgttaaccacagaagatcaagtcatcagtcagctaagaaacctggcagaagaagtagaaagatcattgaaacgtacgcaaaaacacggaaagactgtggtgttgaaagtgcgttatgccgattactccaccatcacaaaacgggtcacgttgccagagtatatgcacaagaaagaagctattttttcacaagctagtttgatttgggaggagattctaggaatcgaaaaagggatccgcttattggggatcacagttacgaatcttgatccattagcttatgaaaatatcgtattgcctttgtgggaaacagaataaaatatatggaggcgcataatgacgacaaacagtcaatggaaagcgttactagaggaattcatggcacaagaaaatccagcacgaaaagttcaaatgcgggcgtacatgcggaaccaatttgactttttagggattccgtcacctgtacgcaaacaaatacaaagaccttattttgctgcaatgaaaaaggccgccatcgattgggcatttgttgaaacctgttggcaactaccttatcgtgaaatgcaatatgtagctatcgactatctggtaacgatgcagtcggtcctccaaccagacgaactggagaaaataagtgaattagtccttcaaaagtcttggtgggatactgttgatggcttgaataaagttgttggtgggctgactatgacctacccggagttgagccaaaagatgcttgcttggagcaaagcagaaaatttatggctccggcgcatcgccattgaccaccaactgcttagaaaagaaaaaaccgatcgcgagcttttagagacgatccttttaaataatttaggtagcgatgaattctttatcaataaagcgattggctggagtttgcgcgattatgctaaaacaaaccctgagtgggtgcaggcttttctgttaacgcacaaagatcagttagctccgttaagtatgaaagaagcaagcaaacatttgtaatgatggtgtgttttatgatcaaaataaaagggaatgtgccataaatctcctacaagtaacactatccgaacattaattattattgctcctgcggtgcagggactcctcgtcgcaaaagtcagaggaatctatcctagcaacagactattattcggtttaacttgttggatgatgacttatgtcacagtcccttttatcttttgtatcagtttgaaaactgaagtttattcaagtcgtcaaatactctttttgatttgttcatagcttttttctgcgtctttgcatttgtcccaaatcaccgcttcgcctagtgctagggatttaggaacatcaatgattcgttgattgctgctaccgcgaaattgcagattcaaattgcgtttgctcaattcgaaacggccatcaactaggatatcgatgcgagacagcaactcaagcttatcttctgtttccaacagtagttcctcgaaggtgtaaccagaccagctccaaatatctttgccatgaccgaactcggaacggactctgtttaccacttgcagacatacttcagtattcaaaaaaggttcgccgcccaatagtgttagtccctgaacataatcgtgccgcaaatcttcaatgatctgttcttcgagttctgctgtgaatggggtgccatagcggaaattttggactgctttattgaaacagccttcgcaagcaaataaacaaccactgacatacaggctattgcggataccttcgccgtcaacaaagttgaaggctttataatctgcaatatgattttgactatactcttttgcttgccattctttggggcgaggatttctcatgtgcaaaacttctttctaactattcgattattcgataaaaatgtccttcgcgactgtagcaaaaaccattagaaagcacaaatgcgcgagcaattccagcactcgttttctgcggactcctgaccaacagttgtcagttagaaagaagcagaatttgcttacgctttagtcgcgtaggggacacttgtttcagtcattatgtttcatatgtttgacacgagcggaaatttctttgtgacgaccgtgaaccattggtcgagcttgaggatttcctaggtaaccgcatgttcgtttgacgacgtcacaactctttggatcgtgattgccacattgtggacattcgaagccgcgttcagttggattgaaatcaccttcatatccgcattcataacaatgatcgatcggagtgttggttcctagataagcgacacgatcatacgcataattccaaactgcttcaagagctttgggattttgttgcagaactgggtattcacaataatgaataaagccgccagaacaatactttggatagtctttttcaaaatccaacttttcaaatggcgttggatttttgcggacatcatagtggaagctatttgtgtaatattctttatctgtgatgtcttcaacgatgccgaatttttctgtatctaaacgacaaaagcgatcggtcaagctttcgcttggtgtggaatagacgctaaaatgatagccgtattcatcgccccaagcatctgcatgggcttttaactctttcacgatggctaacgtgaattcttttgcttcaggatcattttcccactcaccaccaaagaaagcagcagctgcttcatacaatccaatataccctaaggaaacagtagcacgtttatttttgaacaactcgttgacactgtctttgcgatcgaggcgtttgccgaatgcgccatacatgtataggattggtgcatttgccggactcgcttctttgcaacgttctactcggtaaacaagcgcatctttgacgatttgcagacgctgctccagaagagaccagaatttgtcgcgatctccgttagcttctagggcaatgcggggaatattcaatgttacgactccaaggttcatccgtcctacattgacttcttcgccatgttcatctttccagccttgcaagaaagaacggcagcccatcggtactttgaaactacccgtcaattcaatcaacttgtcataattcaagacatctggatacatccgtttcgttgcacattccagagccaattctttgatgtcgtagtttggatctgtgggttccagatttacgccgcgtttgatactgaaaatcaacttcggaaagattgctgtccgtttttcgctgccaagtccgttgatccggatctgtaagattgcacgttggatttctcgctcaaaccagtttgttcccagaccaaagcctaaggaagtgaaaggtgtctgtccatttgaagtaaacaaagtattgatctcatattccaaactttgcatcgcatcgtaaatgtctttttttgtcttgttcttcgcgtaagcttcttggcgatcctcgccgtcgatccattcacgcgcatcttgcaagtgtttttgatagttcaattcagcaaaaggtgcaagtaattcatccgtccggtctgcagaacaaccgccatattgactagatgccacattggcaatgatttgagagatctgagctgtcgccgtttgaatcgattttggtgattcgacttctgcgtttccgattttgaaaccattgttcagcatgcctttgaaatcgattagacagcagttagtcatcggagtataaggatgataatctaaatcatgataatggatatcacctttttgatgggcgttcgccacatgagggggcagcattttcaagccgatggatttccctacgatccctgcagtcaagtctctttgagtattgaagacattgctgtctttattggcattttcgttgaccactgcttgatctttattcattaatttattgatcgtaaagttgatatccgtcgctttgctgcgttcaaaatcgcgacgtgtccgatagttgatatactcttcggccaatgcatattcattttttgctaataaaatatgctcaacgatgttttggatttcataaattttaacgtttttggtaaaccgttcggcgatctcatgatcgattccttctacgatttctaaaatccgttcatgatcgaggggagatagttctcctttaacttttctttgggcttttactaatgcatcgtaaattttttggtcatcgaaatctactaagcgaccatcacgtttcacgatctttaattgggttaattgaggatggctacccccgctttgttcagtatttctctttaagtccatcattactatcactccttatcttctccaatatcataaaacaaaatatggttttcggcaactatatatagtggcttttattcgctaaataattcagtatgcacaatatgtagtgtatattcaaaagcggttttcaataaaaacttgatgataacaaggacttgcatgtttcacgtttcacaaaatgaataaaaattgtaaaaaatttttatgtgtaaaaacgaagcaggggcgatagagaagaaaatatgctaccataaagaaaatatgaagaaaagtagaaatagatcaaggagaatttgcatgaaaaaaatgatcgatgtgaagcacctgacaaaaacctatggaacccgcttcaatcaaaccaaagtcctggacaatctttctttttccgttgatcaaggggaatttgtggggatcatgggaccaagtggtgccggaaagacgacactgatgaatatcctctcctccatcttacgtccgagtctaggttctgttgcaatcggaggacaagaaatcacccgcttgtcagaaaatgagctaagcgattttcgccgaaaagaaatcggctttatttttcaagattttaatttactagacacgttgactgccaaagacaacattatcttaccactggcgatcgaccgtctttcggtcaatgaagttgaccggcgattggcacatctggcgaacttattgggaatcgctcatttgttagaccgctacccagaagaactgtcggtcggtcaaaagcaacgggtggccgccgccagagcaatcatcagccgtccttccgtgttgtttgcagatgaacccacgggatccttagactcaaaagcggcgacagagctgttgcgttatttagctgaaatcaatctgcaagaagatatgacgattctcatggtgacccacgatcctttcactgcaagttattgcaatcggattttgtttattagagatggtgtcttttttgcagaggtagtcaaaaaagggtcccgcaaagaatttttcgaaaaaatcatcgatatgcaagcgacgattggaggcggggatcgccatgctctataaaattggctggcgcagttttttgcagcagtttcgcaattatgtcgtttactttgtgtgcatgatgacggcagtcatgattttttattcatttagtgctatgatgaatgaccgtttgctgactcaacgagtgcagcaagacattcgcatcgatggcgtattaggttttggtagtacgatcgttgctgttgtggtgcttttttttatgctaagtgccaatcatttcttcttgaatcaacggcaaaaagagatcagtgtttatcagctcctgggtttgcgcagagcaaggttaagctggctactgctgagagaaacgttcctcctaaatcttttttcccttgttgtgggcattttcatggggattatattctcgaaatttttctcaatgatcttgattcgagtgatgggactatccatcactagtcatttttttaattcgcctcgttcgattttgactaccgtgttggtattttcgcttgccatggtagttttgagtggtcaagtggttttgtttgtctggcagaatcctttgatcgatctaatgaagaacaactatacactgccagtgagcaaaatgaagtgtcgcccatttcggatggcaatggggatcatcggtttgcttctgttagggatcggctattacttagctctgacgctacgaacgacactggagcgctatattaattatacagaagattatactgctgttttatggattccattgctgattttattttgctgtatcacagcgacgtatttgttctttgactgcacattgccaatgttgttgcatgtcttaacgctcccccgcaaaaaaatcagcaaaggcacacgcttgattgcattcaacaatatccgggcttatttgcagcggacatggaaaagtttttcattactgacgatcattactgcgatcgcgatttctttgattggtggcacgatgggggtgatttccttgaattatcaggcgaccaatcgtgattatcccgtcgattttcaagtcgcagcagaaaatgcggaagagttaaagcaagtgattctggaaaatcagagtcaggtcgtcgcggagcagacgctcacttttcgtatcgtgccgttaaacatcaacgcgaaatacttggccaatccgataaatacaggacaagaaaccgtattggtcaatgcgctttctttatccgattaccgagcatttcgtcgattggtgccggatgcacctgcggtttctttaggagaaaatactgctgttttgtttgatgatgattatgatattgcatacaacttgagaacttaccaaaaaaatattgcgctggaaaatggtaaaaaactcctcttagacaacacgtatcaagattattttggtgatattgcgttgcgttacaccttacccaatgtattagtcgtcaatgacaaggattttcaggacatgtcgggatttgactatcgattgacttatttcaatgttcaaacggagaatcaagagcaattaactcggacgttagatgatcgactttcagtcgaatggacctatccgttttattacaagcgaacacaggacaaaggccaagtcaagtatcagctgcaaacggagatctcagagaagcaacaatcatcgaaggagtttattactggttatcgcttgaacttcgccaatcgctatccgaatatgcgggccattagacggcaaggcggtattattttgttcgtttctttatttgtcggggtgatcgttttgatcactacgtctagcagtttgattgtacggcaattttctaatacagagcgggaaaaaagaaattatcgtttattgcgtacactcggttatagcaaaaaagaaattcgttcgatcgtctactggcagaatttttgggttttcatgccaggtacattactcgcgattttacatgccgcattcgcaatcaacacgctgacgcaaatcatcgtgagtccagggtattgggtggcacatctgtttgcaggtgttgcagccgtcgtattctttattgcttatttgattacagttaagttatgcttacggatcattgaagagtaagctgtcagatttttttcaattttgagctggtacaagacacgaggaatggtataatttaagggataaatgagtagaggagtagataggatggataaaaaagaagagcaattactgattgatctgacaactgcccgtggtgttccggggaatgaagaagaagtacgggaagtcttcaaagcatatgcgaaagactttgccgaagatatcttttacgatgggttaggaagcgtgattgccaaacatgtaggggatggcggcggacctaaagtttttatttccggacatatggatgaagttggctttatggtgacaaagatcaccgataaaggtttcatcgagtttcaaacattaggcggctggtggggccaagtgatgctggcacaagaagtagaaatcaaaacgcaagctggcaaattggttcatggtgtaatcggttctaaaccacctcatgtgttgacgccggaagttcgcaacaagccttatgatatcaaagacatgttcattgatatcggtgcttctagtgaggaagaagcaaaagattggggcgtacgtcctggagatatgattacgccgtatatccaatacaaacggatgaatgacagtaagtttttgctagctaaagcgtgggataatcgtattggaacagcagtttctttgcgtgtgttggaaacgttggctgctgaagggcatccaaattgcttgtttgctggcagtgatgtcatggaagaagtaggattgcgtggcgcacgaacaagtacgcacctagtgaatccagacatcgcgattgctcttgatacggggacagctggtgatacgccaggaatgactccaaaagaagcagattctgtcttgggcaaggggccgcaagttttgatttttgatgcatcgatgatccctcataagaaactcttgaattttgtgatcaatgttgcggaagaattagagattcctttccaatatacggtgatcaccggtgggggaacagatgccggtcaaatgcatctgacccgtgatggtgtaccatcgatcgcgattacagttccagtgcgctacttgcattcccatacttctgtcattcatgaagatgactacttaaatacagtaaaattagtaacagaagttgttcgtcgcttagatgacaaaaccgtgaaagaattacgaagctattagaaggagtagaggatgagaaaaaatagtgagatccgctccatggcatcacgtgcattaaagggcatgtgggggcggtatattttagcctttattgctacgatagccattcaaagcatggttagcagtttggtgctgtcattgacaaaccatacctttcaacagacacgagaaacaatcattgattatattttggaatactttgtttttttcgcattgacgataagtttaaatatcatggcactgttcttgattcgtcagcgggagatccatgtgtcggatatttttcttgtttatgacaagcgttattacgtaccttttctattgctgaatttggtgaatgctctcgtaaattatctgattagttttgtgacgtttttaccccatttagttgttggcggaatgaatcagtaccttgatttagtcttgaatgtcaacagtcggatcactgtagactggagtctcttccgttcgtcgatttccttcatcatcagttttcttatttctgtggtccttttcttatttgtctcccagatcataagcggattatttcagtttgcgatctatgtacgatacgaccatccagaaatgacgacgctacaagcgataaaaggagcttggcatttaatgaagaatcatatcggtcagtatattttgctgcagatttctttattaggatggatggttttaggtttgtttgcttttgttatcggtctattttgggcgctggcctacgcaaacactgcgaatgccgccttttatcaagcgttgatcgaaaaagaaaatgatcgcgttcttagctaaagaacacctcttgtaaagatatgatccacggttgtgacgttgggtgactcaatgcagcaatgagagagaaaatcatcgatttcttttggctctttgtcaataaggactgatgggttgtacaaaatcaaatctgggtcagaatgaacctcattctggctcagattttttgttatcttactttgattaattgattgatcaaaaagattctaattctcatgttctcaaatgatttaaatccgtaggatactcgtttcattgtctttatatgggtattcttcgcttctatttttccattggtgtaaggatagatcatcgcgttggtgatgccttcttcataggtcaaancaaagcaccgcaaggaacagttccaaaacgaagagtcgatggaacgtttcttagtctcgtcttttgatacttacaaccaaaaattcctaggtcgcagtcataaaggctttcaacaggctgaaggcgaacttgaacaaatgctaagccaactgattgagaattagaaacaatctgcagtagggaagaatcatttacacaaaattattgacgctcccggtaccggtggtgggaagacatatttcattcttacaattattgaagccctactacgaacaaaagctaaattatttattttagaccccaaaaatgcagatttagctgatttaggtacagttatggaaaatgtctattacaagaaagaagatatttctgaatgtatagatgatttctacaatcgaatgattaatagaagtttagagatgaaaaaaatgtccaattataaaacaggagaaaattatgcttatttaaaacttactcgatttcacttttaatacgaccacctcccataaataatatttaaatttatggaaaggaagatggtctatgaatacactgaaagaagattttattttagcaaaagctggaaatgaagaagccattgaagccattcttaaaagattcagctcgttgatgcacaaaaaatcgtggagaaacggaaaatacgatcaagattgttatcaagaatgtatgattgcagtctatctagcaatttcaaaatttgaaatcaaggaataagctcattttggggagatgcattttgcttctccctttcttcttatctacctcaccttatccattaaatttttcaattcagttacatttgttaactcgattatattaggaattggctgctttattagattattcctagtgagttttgttaaatatctactaagtgtttctggagtcatccctaaataagaagcaagttcttttttcgtagtttccaattttatctgctctgtattttgctttatattttcttctaacaaatactgaattaagcgtgtttctgctctttcagtcgtgattcctacagttaatcgttctgtattatcaagacgtctcgccatttctgataaaagttctagagctatttggggatgcgatagtaaaatccgcttaaagttgtccttttgaatggtacatactttagttggtgatattgcttctataaagcatccataatgttgttcttcaaataatgccagctcgcccacaaaatcaccctgttctaaaatacgaatcacctgttctttacctgaagaacctaagcgataaacttttacttttccttcttgaataagataaagagattcaagtatatcttctgcttgatagataaactgtcctgcagaaaaagcttgttctgtaatatcactttggataaattgaatttcagtgagggacaatccctgaaataaaggcattgtacttatacaatgatcatattttgtgaaatcaatcatgttcttactactcctctttttgtggttagtatagcataaaaaaacgttcactcatgtaatatcatcagtgaacgattttctatacttatttttctttatctgcatcataaagaacagcgcgtactgaaacttcaatggaatcctttactgctttagaatatggacaaactttatgcgcttcttcagcaattttttgaacttcttctaaatctaaatcttgaattgcaacttgaatctcaacacttaatttaaagtccacatcgtctggctttttgtataattttactgtatgtgtaacttgtgaagattgatgaattttacgttgacccttaacaatttctaatgccccgtgaaaacaagcactgtatcctaaagcaaataattgttctgggtttactccactcccagatcctcccatttctttaggtgtagaaatcttcacttcaaatgatccatcatttaaatagctcactccatcacggccaccggtattagtcgctgttgtttcgtaaatttttttgtaatctgacatattgaagtcactccttttcacttttatggtcctattttaggaaataaagttggtgttggcattgatctaaatcaagaatcataaagttaagaataactttatgaaaaaatatcgttggatgcagtatatctctttacttgaactttattagctatgtttattggtctttttgttaaggtaaataaatattaacaaagctattattgcgcctccaaaagaaccacctatcgcaataaacacatccactgttccttgaattcgaatgatatttgatttagttataaaatggatgaactatgatataattttttgctttaggtttccttcagattccatcagctacaaagttgctacccgtgcagggtacatcaaaaaaggaaatgccaaagcatttcctaaagtgtgatttggtcaaaacaacaccatttgacaaagcactgaagaaactagaatgacttttcatcaataaaccctattgttcgttcagattttccatttactccaacacaaaggagtttttgaaaacaaattcactcctccctcctaaatcttcttaaaaaccattattctccgccaatgtcttaaaccattccccagatttcttaatcgtcttaatctgagtgtgaatatcattagcgattaagccgtagcggttacggtaggcattgctccaggaccagcaatcgataggagtccatagatggtagccaaagcagttggaaccttcttcaatccctttatgcaaccattggagatgctctttgataaattctatgcggtaatcgtctagaatttgccctttttcatccataaagcgttcttcccgagaaacccccatgccattttcagaaacaaaccaaggtagattgccataattatcgcgaatattgatggcaatgtcatacactgctttgggatagatttcccaacctttgtcaatattcatgcgacggccaggcatttgatatgcatcataataacgatcaggcatccaggcacccactgaatttggagcaatgtcaggtgtcttgacccggtttggatgatagaaattcactccgataaaatcaacagtattttccttaatcaaagctaactcatcagcagttgactgccacaataccccatccttagtcagcaattctagcaattccacaggaaattcccctttgatggctgggtcgagaaacattttattgttccacagttcggcaattcgggctgcctcttgatctgcttcagcatctgaagctgcgtaagttggcgtcaagtttaacacggtaccaatccggccaccagcttgtggttgacccatttcgcgaaacttcgccatgaccttagcggaagcgagatttaaattgtatgccacttgtactgctttcttgccatccaccaattttggataatgaaattggaacaagtactccccatctactaccaccatcggctcattgtgggtcacccagtctttcacacggtcaccaaacaaagcaaaacattgttcagcaaatcccacaaacaaatcgacaactttcttcgattcccaaccgccatatttatggtaaagctccactggcaaatcaaaatgatggaggttaaaaatcggtcggatattttgagagaggaactcatcaatcacattattgtaaaaagcaacacccactggatccacttcattggtttccaaatccttgatgagacgggtccattgaatcgaggtgcgaagggaattcaatcccgtttgcttcatcaatgcgatatcttctcggtagctattgtaaaagttcgaagccatatctggccccactcggtcataaaaaacttcaggttcaatatcgtaccaatgatcaaacatattggcatgtttcttttgaaaacggccttctgattggggaccagatgtggctgcaccccaccagaaatcttttggaaatgtcaacatagcattctactccttttctctcaaaacgtcggctaaacactgccgcatatgatcgccaaattttggcaagtattcatggccatactctggataaaatagcatttctttgtcagctgcgctacttagctgattgtacacagcaaactgggttttcggtggacagactgtatctgcaaggccaattgcccaatgcaccttccctttgatccaaggagcaaagtattgcaaatcaatgtaatccaatgtttcaaagaaagcttcttctcgttggtgcaaggggtctttaaagcgaaaccaataagccaactcttcataggcggagttttctacatctaagcgataagcttcgcgataatcacttaggaacggataacaaacaaaagattccttgatttccggagcaacagccgcacaaatcaacgccaaagctcctccttgtgacgcaccataggtatacagttggctggtatccacttggggttctgctaccattagccgagtcaactggtaaatatcgagaaacacacttcgataaaataaatcatttggtccagactccactccccggattatatgccctttcagactggttttcgtggtcaatcccacatcttctgacaaaccaccttgtcctctaacatcgagtgccactacccaaaagccttcagcagccatagcgaccttgtctgaccaatccccagcatctgagtgatacccatgaaattgaagcaagaggggagactttttttgcagacgtttaggccgaatgagttgacaatggacggtggctccttgaacacctgtaaaagttaaatcaaatgcttctgctactgaagaattcaagggatgaggctctaaatgatagtctgtccccaaatcatctacctcttgaaaccctgcctgccaaaaagcttcaaaatcagcaggctctcgctgactcccttgatagttttgccaccttttttttgcatctattgcatacattaaacttgctcctttcgtaagtgatagtttgccactgctcctatcagattagcatcttgttgaaactgacaaatcttcacagtaattcgttggtcctctgaatgatgatgttgttgtaacaaacataattgggcttttaccggagccaatagatctttgcgcattgatatgccaccaccgatacagactacttcaggatcgatgaccaagcaaacattataaataccaatcgccaaggctcggaacaattgttgaacttcttgttgagccaattgatctccagtgtcagcaatatcaaatagttctcgacctgtaatacctgataccaaacctttctgttcgcaatagcgctttgcagcatgaacagggctggctaactcacttaacgtttgtccattttccgccaacatgtagccaaattcgcctccaaataagttatgccccttgactagtttccgctccaacaccacggctccaccgattcccgatccaatgatgaaagaaactgaacttttggcatctttggcagcaccataaaaggcttctgctaaccctgcacaattggcatcattttccacgaagacaggtttttccaataactcctctaattctgcaacaaaatgaattttatgaatataggggatcgcactgtagcccccgataatcccctgatcactgtccactgctccgggtacactgatcgacaccgcttcaatcggtgtctgactacaactggttaaattatgcaaagtggcttttaggtccatcttcatttgctcccaagtcacgggtgtcacaaaggaacctttttcggtcaaggcttctgctgcccacagagcatatttgatactcgtacccccaatatcaattgctaaaatactcaagaattccccctactttctcagtctacttacctacactaattttcattgtaagtagttatttatttttaggtatatacttttaaaatttgaaaatcaaaataaaaagcggaaagaggatttttccgcttacttattctctcgttaagacaaactccaccgaaaaactatcataacgatgaactgaaatggagtactcaaaagcgatgcctgtatcaaaataagcaatttgctctgccactgccaccggatctcccgaatccaattctagatactgttgttcgatttcagtcgcctttcggacactgacgcgtcgatgcccactttggattttcaaaccgagatcttcttcaatatattcataaatggacccttcaatattggcttttttcaaaccaggaatcaaatcgataggcatgtacattttttccataaccaacggcttgccatcaatgtgacgcacccgataaatatcatacacgaaagtatcttcctgcatatttaatttattttttaccaagttatccgcttctattaccttaaactccaaaactttacttttaacttcttttcctggattgagagcagtcgtcccacgaaactgattagccaccgcaattcgttctatttcatcggtcgccaaatccttgacaaaagtaccggatccacgacgtttgataatcaatccctctgacactaacatatctaaggcctttttcaccgtcatcttactagcgtcatattccacacaaagatctctttcgaagggaatttgttgatttgcttgatatacaccttccagtatcttcttacggatatcactggaaataaggatatattttttcatcgtcatgttacctccacttatggcttatcctaatatcttatcctatctgctaccgaatggaaatagccagccactgtccttttgaaattatttatctactcgtcgtaaatgatacagttgagacgcataatcccccggcaattgacgggaccaatagtcttttgctcgaccgacatagttgccacccataatcaagccaatgctagaaagatccttaccggaacgtaattgtggcagttgattgatttgataattagcttccaaatctaaaccggccaataataaacgacgataagccggattcggtttacccaacacttgataatccgccaccaaagcttcactcaaatcttttgaaactaccatccaactacactgggtattatcaaaaggactattgagacgataaaaacgcccctcgtggatcaattctcggtattctttaaaggtggcaatcgctgcttttacctgttgtagctctacatctgacatcctcgtaatatccaactccaaaccataagtaccaaacatcgctacctgattacgaaaagtcagtcctggcgaacgccctacttgatgattgggaatctgtgacaaatgactaccgatactagctaatgggtaaaccatcgaagccccgtattgaattttcaagcgttcgaccccatcagtatcatcactggcccaagtctggggcgcatagtagagtaacccaggatcaaaacggccaccgccaccagcgcaggattcaatcaacaaatcggggtattttgctaagattttttcatacaggtcataaacacctaaaatgtagcgatggaacaactctccttgattaccatcggcgaggtaattggaaaatggttctgaaatataacgattcatatcccatttcaggtatgtaattttgccacaagcaagaacgcaatcgatttgctggaaaattgtctccaccacttctgggttgctaaaatccaagacaaactgattccgtccatgagagatttgcttctcagaattaccaattacccactcagggtgcatctcatacaagggtgtatccgtagaaatcatttcgggttcaaaccacagcccaaattccaaacctaattgattgattttcgtcgcaaaggcagagatcccctctggtattttggctagctgcacctgccaattacctaaagagccgttatcactattccgagtaccaaaccagccgtcatccaacacaaacagatccacaccgattgctgctgctttttcagcgatttgtaataatttctcactgtcaaaatcaaaataagtggcttcccaattgttgattaaaacaggtcgttgcttatgagaccagcgaggtgatatcaagtgctcttggaaaaaatgatggaagctttgactcataccattaaaaccggcctcactatacaccagtactgcttccggtgtcaaaaatgtgctttttggagttaattgccaagcaaattcaaaaggattgatacccatttgaattcgcaaaatgtcataagtatccagctgcaaacgtgccacaaaattgccactataaattaagctaaagccatagatctttccttgttcttccgtcgcattggactcacaaacagccataaaaggattgtggacatgactgctggctccacgagtactggcgacttcttgcacaccataagcaatggaatttctactaatctgggtttctctcgcccaagctccatccaagtgtagccaatcatagtgctgatttggaagatccagattaaaactcagacagtccaataactcaaaggtcgtctcactaggattgatgatcttcatttgtctggtcactacagattcttcaccaaacaaggtatagtaaagctcgacttgcaaaggtgaataacgatcttgcaaggtgataattaaagtctcccccgcttcaccaaaactgccaggcaagccagaaagtgcctgttttcctaattcaatccgatagtgttgataggtaaagtgactaatacgatctccttttggatagcgtacccgtagcatgggatagcgaaaatcagtggtaccatagaggcccacttcttgtttgatatgttccaacgaagtagtgtagttttgcttgatttggttgttagcgggacgtatttctctttcaatcaaaaaatcatattgatcataaataggaatactacttccaaaatagagttgttccaagacgtctaactcttccattacccgaaaaatataactaatgttctgattttttaggtgaaactctcttctttcaggattgacactaatcatgatttattccttccatttcacgaaatttttgcgagccttttttcagtaaataggccactccgccaggagccaccaagaaaaacagcaagggactgaccagcaataataggatccaaaaggcataggtccccaagatgaagccatttagcaaactgggtcgtaatgtctgaagtaatagctgatacccaatagcaacaggagcttccttcatttcgtcatacgtcgctgttcccaagacccagtgtgcattatagagtaagaaaagaagcaaagataatcccccagtaactttaaaaaacaagcctagtgaagtgctaccgagccacgcaccagataaaaagatcgccaaggacaaaaatacgcccacagatagcactttttcgcacagtttcgtaggtggtagcttcttggttagtcgacagagcttttcttgtaaggcttctggatggtcgacacaaaaaactaactttttatggctactaacccagccataaataaagccaccagtgactaaccagccccaaaaatgcaaggaacactttactaggacatagagtaattccactgcaactactaatttactggacttctcggtcaccagtaaccctccttttccggtaagcttatttcacagaaccagcaacaccattgtaaatgtatttttgcaaagccaagaagacaaccaaaatcggtaaaataacaataattaccccggctaagatcactggccagttggttccataagggcctttgaatgcaaagagtgccgtggagatcacttttagtttacgatcgggcatatacaagaatggattatagaaatcattgtaaacacccacaccgctgatgattagcatagtgacaataggtgcctttaagttcggtaaaataatccgccaaaagataccaaaatagttggccccgtccaaataggccgattcgtctagagagactgggatttcatctaagtattgcaaaaaaacatagatggaaatcacatctgttcccaaatttagtaaaataactgaccaaatcgtgttgaacaagccaattccttcaatgatttggaacgtcgctacttgactagtaatgccaggaatcaacattgccatcataaacaaagctataatcggctttttcagtttaaaatcaaaacggctcataacataggcaaacatcgagcctaacaaaagcttacctaccatactaattgaaaaaataagcaacgtatttttaaaacctgtcaacatctgaccattgataaacgcagttttgtaattactaaagtccaatgactttggtagcgacaagacactggtagacaaaaattcattattggatttgaaagagccaataaaaactaccaggattggtagtacggcaaccactgccccgataatcaaaatcaaatattgaagtatacgtccgatagaaaattgtcttttcatcttctatgcctccttctcgctaataaatttccgttgaatcaacgtcaccactaagacaatcacgagtaaaataactgccatcgctgaagctaaaccaactttattatacttaaaggcagtatcgatggtttggattacaaaggtcatggtgccgttggatcctccagtcataatatatggaatatcaaagacactcaaggagccgcttatgcccaaaatcagatttaggaagatgattttgcgaatacttggtacgatgatataacgaaactcatcccaacgattagccccatctatttcggctgcttcataaacttctggattgaccgactggattgctcctaaaaaaatcaaaaagttaaagccggtataacgccacaaggaagtaaaggccaaagaaatattattgatggagcgatctcctaaccatagccgaatttgactctccaaacctagcgccgatagcactgtatccaaagttccatcacctttaaagaagtacaagaaaataaatccaattgctaccccatttagtaaataagggaaaaacaaaatccccttccaaaaattagcaaatttgaccttaaaggacaaaatcgttgcaaacaataaagcgacacccaattgcaaaaaagttgcaaagaagtaatacaagctggttttaaaaacggtaaagtattttggattggttaagactgtcttgtagttatctagtccgacaaatttactgtctggggaataaccattccactctgtcaaactgtactggaacatcttcactaaaggataataagataacattaataataaaaataccggaataatggtaaaagtaaagatcaagattcttttttcagttttttggctaaaacgggattttttcaccgtcttattcatggtaaactctccctgtttattcatgttggctcctccttattctaaaacccctcatatcgaccacggtccgcaatcgctatgtactcctgcaaaagaagttactaccaagataagttttctttacgacactgtgcttttgcctggcacaagttgccagacaaaagttagtgcctacaatcaaaactttatttgctatcaatcaaaagtcttttcctaactgctagggtgacttctaaaaaaattttactctcccacttctgctatcgcatctgaccagcgtgtattgaagtctttcataatagcttcgaagctttcgttagagttaccaactgctgcatcgatgattcgttgcttttcagcatctgtcgtacccaaacctagttcagattggtcattgattgaactaaacaatgattcttttccggctggtgctggattttcttcaattaactcaaccccagcatcttgtgcagccttcaatgattctggataatctgctccaatttttgctgacaagcccccgttttcttccgcgtagtctgattcattgactaaccagtcgatcaacttgcgcgccgcttctttgtgcttactatgaacgttgatcccatagttataatctgctccaattggcaaatattgtttaccatcctcggcagtcattggaaatggttggaagataatgtcctcagcagtatcagcattgatgtctttgatttgtggtaccgcccaacttcccaaaaccatgatcccaatcttaccattagccatatctacttttgattgttcccaatcagatgtagttgggtcagcctcaatcaacccttgattgctaacatcgtatagggttttataaatcgtattcatcactttacccgctgcaaatggctctttgtctgaagtcatcttattggtaaagtctttatcaccagaagcaccactgcgaacaaagtcccagtttgataatgtccaaccagccgcatagttagtatatagcggcatcacatcagtatttttttctttgattgtttttaatgctgctacaaaatcttctggtgtttgtggaaattcgtcaataccagcatctttgaagaccttttgattgaccaccatcccagtggcgttcatctgtgacggtaagccataactcgtgccatcataggaccgatcatttaaacccatatactctttgctgagctcttcctttttaccaagtggttcaaaaaagttcccataatcttctggcttgatatctcctggaatcatcaaaacatccccatattcttcactattcatccgggttttaatttggccagcatagtctgtaatcgtttgaatttctactttgatatccgggtacttctcattgaattttgtcatgtattcatcccattttccattggtttcccagtcggttttgtggttgatgaaggtaatggtctcagttttcccaccatccttgtcattagctgaatctttgttgtttccacatgcccctagaactaaacctgctactcccaagacgatcattgaacctagcatttttttcttcatgttacttcctcctataaattaataaagtgctgttaccaaaaactgttcatggcctgttacgtcagaaatggaaaacgattacataaatataatactacattcccatttcaaagtatatacttttatatatattgttttgtacttttgtaaaattctcgaatgatcgccgcagccggtttaccgtaaaccccgtaatcgtcgtctttgagcgccacctctcgcgaatataaccgcgccttccagtcccaaataccaaagccttgaatccagtttctcttgtcacaagcagtaaacatcttttcaaaccatcgtgattgcgctatcatgctaacttcccctgaaaaactccaatcattgggtagatattgacttccttcacgacttggacaacccacttcacaaaagaagaaaggtttttggtagtgatttaccacttgttcaatccgatccaattcttgttcccatttgtcaatcggataatagcctgatgaagagatgacatctacagcatcccaccaagttagattattttcttgatacttgtcacaattataagttagtagaccattgtaatgctgtcgaatctgggaaatagtttcccgccactgagcttcccgtcgatcactattaaccaattcacagccgattaccaacatgacacaccctgtctcttcagcgagttttgcatagtgattcaggtattcacgataggaatcaaaccattggctccaagtcggctcgcagggaacatcgtaatcaaaaaaattgatgtgcgctcgccacgtaccatctgccacattgaccatgggtttcaagattactttcaacccgattccctgagcgtaagcgatcatccctttcacttctgcatctattaaaacgttgtcactttgccaatcgattttggtagactgaggatgagcttgtgtgacagtaattggtaatatcacatgacttgcagctaactcttctttcatcatgcgtaatgattctcgactcattggatcttgccagtctccccgttggctcataaacccaaaagttatcccattgatagtttccatcttttcacttctccacgttttattttgtaatcgatttcaattctatattataaaggacgaagaagaaaaaaaacaacaaaaatatatacttttgattataatgatttatacaatatgatatagtaaatataataaaattggaggtcttttttggataagaaaaaattgtacacgtagctcactcaaaaaatcatccccttctggcaaggtaagatggatctaattcatgatggtttttacggtcgtcgggataagatcccactactaataagagctgcttgatgaacgcccggtatttatggagttttagtcattgctgccgcattttacaagacaaatccttaactgagtcttttttagctagcctaaagactgctgcgaatcctgcctatgaatttttccggtaagtctgttgggaccaggaaaacccaggggatcttctgggagctaaccgcaactgaaatactctctgatcccaataaaaccacttatgctaatagttttgccctctatgttcttagcgagtattacttagactttcatgatctgtctgcattaaaaatggcaaccacgctctttagttttctcgaaaagaagtcttatgaccctcttacaaatggttatcaggaggatttttcccacaactggtagcccgttccctcccaatcaatcggacccagcgatttgccagatctagactttaccactaatacccatttgcactttttagaggcatatataaatttctacatgacgacgccaacattcgatgtaaaaactaccttgcaaagattactcattgtctttacagataagattgcgaccccagcaaactgcctccaatttttcaatgctgattggtgtcctctaagccaagaaatcagttttagccatgacattgaaaccatttgggtattgcaacggactttgactgttactagtatcaaagatgtgcaagtcagtcaatttattgaaaatcttggtactcaagtagctaccaaaggcttcgataacaacaaaatcatttgtgatcattcaaatacccttcaaacctcgactcgaaaaacttggtggacgctagcagaagcaatcatcggcttttacaacctgtatcaattaactaatagtaaggtctattatgaattggctactcaccacttcgaaatggtagaatgaaactttgtggatactcgatctaacagtgaatggtatgcctacctcatcaatgatggacaccagattctacagaagatatcgccaacgcttggaaaggccccttaccatacctgtcgtatgtacacagaaacaattgcacgcctatctaggtaagaaaaacaggacgacctgacttctagagaatcattcgaattgtagtgacatcgcaaaaagccaactaaagaacagttggctttttgatagtttattttagtaatttctgcttagatgcaaatatatgcgcaaatggttctttagctcttggttatccttaatactacaacctaattgattctctccagcaactccaccctatttttcataatttttgaattaaaataaaggtaatcccttttaattttctatctttatttcaatatcagaatttattattttaaatttttacatacctgtttatgaaaaactaaataatctgtcaaaaaaatatgattgttcatttctaaatatgttttccaattttaaaatcttttttagcatttttgtttccttttcatatggtttttcgttgttaatagtgactaggatgatattcctattttgaccattgacaattaaatataatttttgaataacgttccctgctattcgagctaagaattcaagtacgccatgacctatttagcgataactacttagagatttctttttgttttgggaagacaaaatgccatgacaatagcagtagataatgatacttccgtaaggctcgccgtaaactggggagaggtgaaattcctatgtgcttacccaaggcaattcaaaaattttagttcatttataaggggatgattttattaaatcaatagtctatctaaacaaaaaacaaacctgtgagtttttaggaattgataacaatactttagataaatggattcgtatatataattttcccgtaataaaaatagacggtataattcgctttgatgtagaagatatcaaaggctttatggatacgttcaaaaagatttgaattttacttttgactgcatatactaaaagtagcgaaatatactgccttacttttttattaaggagtgaggaagttgcctacgaagctttcaaatggaaaatataaaactaatttgagatatccaaaaaaatttaaagaaattacaggtatcagttcagaaaaattccaaaaaacatttccaactaggcaattggctattaaagccgaaaatgaaatgaaaaagaaaatcgcaaaagtcttaagagaggagaatgcaaattcattagagctcaaaggtcaaataaaattcaaggagttttataaatctaaatggcttcctagatatgagttagggcaaactactagatcccataaagctccaagcgatataaccatcattaatacaaagaatttatttcgattgcatattctgcctatatttggtgagtatgccatgagctatcttaatgcaaataccgaaataatatcagatgaactcacaaaaaagtcgaaggaatatgcaaacataaaaatcattaaatgctatgttcgttccatgtttgatattgcagaggttctaaattatattgaatttaatcgtacaacaaaaataattcaaagtattactgcacctaagaaagttgctctggaagaaaaaagaatacgagaaggaaaacaagctttatcttcgaaagaactcactgattggttagacactgtaagagatgatttcaatgatcaattactttcctttcacgattacactctttttatgcttactttatatcttggggatagaaagagtgagacctatgctttgcaatggaaatacattgattttgaaaaccaaacagtccgtcttaaatatgccttggataaacacacaaaaaagaaatttacaaaaggtcgaaaagatactattatccaagttccggaaattgtaatgacactattgcaagaatggaaatcagtgcaagctgaacaactattgaagttgaaaattaaacagacacctgaccaatatctttttagttactccaaaccttctggtgaagtaaattgtccagtccatactgattacttaaattatcgaattaattctataaaaaaaagacatcccatttggttcatttaactcctcataaacttcgacatacttacgcaactttagctagacaaggtggggctgatatgaatcaaatttctaacgctttgacacattcaggtatttcaactacaaaaatttatgtgaatacacctgatttagttgataaagctgtgttcgaagcgtttcagcgaggattacaaaaatctaattaatgtgttctagaatgtgttctaaatataaaaaaaagacactttccaaataattggaaagcgtcttgaacgttgatatataaaggatattaacgttttgaaaactgtgaagctttacgagctttcttaagacctggtttcttacgttcgaccatacgtgcgtcccgagtaagtaaaccagcgcgtttaagagctagacggaaatcaggatctacttgtagcaatgcacgtgcgataccgtgacggattgcacctgattgtccagcatatccaccaccatttacgtttacaaaaacatcatatgatcctttagtttctgtaacgccgaatggttggttgattacttcacgcaggtcagcgtgtggaatgtattcttcaacatcttttttgttaacagtaattttaccagtacctggtactaaacgtacgcgagctactgcatttttacgacggcctgtgccgatatattgagcttgtgccaatgaaattccctcctattagattaagtttgtgatgtccaatacttctggttgttgtgcagcatgtgggtgttcagcgccagcataaacatgaagtttcattccttgtttacgtcctaaagtgtttttaggaagcatgcctttaacagaagtttcgatcaaacgacgagaatttttagcacgtagttctcccgcagagactgatttcaatccgcctgggaagtttgagtgacggtaataaattttatcgcttgctttgttacctgttaatttgattttttctgcattaatgacgattacgaaatcacctgtatccacatgaggtgtgaatgttggtttatttttaccacgtaagatagatgccacaactgctgaaagacgtcccataggaacatccgttgcatctactacgtaccatttacgttctacttcgcctggtttggccatatatgttgtacgcacgatttttttcctccaattcaatttcacgaatgtttgacatacacttgagtttccggggctctcgtggggcaaacaataccatataacataataccgtcttaagcgccacatgtcaacgtgtttcgcagtttttttgaaatttcccttcaattcttttccgaaaactttcagttgttattctgaccaaacagcctgcacttttatacacattttgcgcataatttgtatacttcctgcaataagtatctctggtttttattattatatcaatctgtatctatatccttgctaaacacaagaagaattcattgtataaatatttactttttctcttgatttcttatttttattctgttacgatagcttcatcttacttgaacttaaggatgggagttaatcattatgaaagaaaaagtaattttagcgtattctggtggacttgatacgtctgtttccattaaatggctgacagatcaaggatatgatgtggtggcgtgctgtctggatattggcgaaggccgtgatacacaatcaatcaaagacaaagcactcgatgtgggtgccatcgaatcctatgcgattgatgcccgagaagagtttgcccaagactttgcattgattgccttacaagggaataccttctatgagaactcctatccgctggtctctgccctttctcgtccgctgattgccaagaaactagtagaattagccatcgctacaggggcgactaccgttgctcatggctgtactggtaaaggaaatgaccaagtccggttcgaggtcgcgattgccgcattagcccctcacttgaaagtcattgctccggttcgggaatggaaatggtcccgggaagaagagattgcctatgccgctgaaaaaggggtgccgattcctgccgatttggataacccttattcgattgatcaaaatctttggggccgggcttgcgaatgcggggtcttagaagatccatgggcgactccccctagaggcgcttatgccattacgcaagaattggaagatactcctgatgtaccgacgatcgttgagattacttttgatcaagggattcctaccgcattggatggcgaaacactgaatctggccgaattgattatgaaaatgaatcgtctagccggcgaacatggtattggtcggatcgaccacatcgaaaaccgtttagtgggaatcaaatctcgtgaagtctacgaatgtccgggagcgatggctctaatgacagctcataaagaattagaggatttggtttttgttcgcgagttggcccatttcaaaccaatcatcgagcagcaactggcccaagtaatttatgatggcctctggttcaatcccttaaccgatgccttgatcgcttttctaaaaaacacacaagtctatgtcaatgggatcgtacgtttgaaattgttcaaaggcaatgtcatctgtgaaggacgtaagtcagagaacagtctttacgatgaaaacttggcgacttatacgtctgccgataccttcgatcaacacgcggcgatcggattcatcaaattatggggactgcctagcaaggtccacgcagagattcaggcacaacagcaattaacagaaacactgatttagtcaataaggtgactttttccttttgagggtgaagtcaagtttctttcgaggtgagcaaaatggcaaaattatggggcggtcgtttcgacggcaaaaatgaagcatggatcgatgcctttggagcgtcgattcctttcgatcaattattggcaaaacaggacatccaaggcagtttggctcacgtcaaaatgctgatccacacggggatcattgatgaagcagatggcaacaaaatcattcaaggcttgttagcgatccaagaaaaattagcggatggtgaactgaccttttcgattgagaacgaagatattcatttgaatatcgagacctttttacatgaagaaattggacccgtcgctggcaaattgcatacggcccggagtcggaatgatcaagttgcgacggatatgcacttgtacttgaaggatgtggtaaaggaagtcatcgacttgattgcggcgttccgtcacgtactagtggagcaagctgaaagcaatatctacacgatcatgcccggctatactcacctgcagcatgcacagccgatttcttttgcccatcacttgttagcctattacagcatgttgacccgcgatcaagaacggtttacagaaagtctcactcggatcgatatcatgcctttaggcagtgctgcattggctggcaccacattccctatcgaccgtgcctatagtgcggaagcattaggttttggctcgatttacagcaatagtctggatgccgttagtgaccgtgattttattctggaatttttgagtaatgccgcgattttgatgatgcatctttctcgtttttgtgaagagttgattctttggtgcagtcatgagtttcaattcgtggaattgacggatactttctctacaggtagttcaatcatgccgcaaaaaaagaatcctgacatggcggaattgatccgcggcaaaacaggacgtgtctatggcaacctttttagtttattgacggtcatgaaaggtctgcctttggcttataacaaagatttccaagaagacaaagaaggcatgttcgataccaccgaaaccattgtgaaaagcttgcagatcatgaccggaatgatccaaacgatgcaagtcaaccatgagcgaatgaaacgttcgacagaaaaagacttttccaatgccactgaactggcggattatttagcagataaaggaattcctttccgacaagcccatgaaatcgttggtaaattggtgagtgagtgcctcagtaaaggcatttatctacaggatatcccactagaagagtatcaagcagtccagccagtgatcgaagctgacatttacgataaactggactcttatacggcagtcaagaaccggcattcttacggcggtaccggatttgaccaagtcaaacaacagatcgaagccgccaagcaatccttggcattggcataaaaaaaaggctgcagaagaactagctaaccaaaataatctcaacgatgataaatgaatggtgtgatccattacctatttgcgaatcggttctgctaactgcagagacaatctcatcgtttgattattctgtttgctgaagggcttctgtcaaagccttttttatgtctatcagaaatacgaaagcctgtgctttataaattctgatagtgaaaaacttgttatcgttttcctatacaagtacctgttggattaagaacaactaaccttttgattgttacctatcttaatcaaaaatcatctaatcaaaattcgtatcctttagcaattttcctgctgtattagcgactcgccaatcgctccccctggatgccattgcacatacatttctggggttaactttcgagcttcttgcaagagtagcgatagcttttgtaaaacaatgatttgtaccaaaaccgataagcgaggcggcttgttcaatagatccccttctttatgaactgccgcgcatagggaaacatccgataaatgactgagcgtagagtcacttcttttggagacgccgataatttttgcaccattattcttaagtgtctcaactgtatagagtagttctttggtttccccactgttagaaatagcgatcactacatcaccagcttttacttgaccacttgatccatggaccgcttccgttccatctaaaaaatagcttggcgtaccggtggatgaaagcaatgaagcaatatatcccgcaacataagagggttttccgatccccgttacatggacgcgccctccgtcagcttctgtttggagaatcgtctctttcgcagcttctaaagatccttcatcgattttgtccatcgctaaagccaattcatctagtacacactgatcataactcaatcccattctttcacctgatttctatttattgaaaaccgaataatcttttgtatccataggtgtcgtttggaagaaaaacttgacgcctttttcttggatttctcgtatagctgtcatttcttcctgagtgaaatattcatcgattttcttcaagagaattcgacttgctggataaggaagttgcacttcttttgaagaaaaccccttattcacagcctctcttagcgcacaaatatttttgaaaataatcattacactgcatttttcttccgtgtcctgtgctaaaaattccaataattgatcgactgagaagatactaactttacttttattagaaaagctaagctgcaaaactttctccaggaaaggatcatctttatgagtaggatctacaatcgcgatataactagcattaatgaagttgttccaattcaatgccactgttgcatgcaacaaccgtttgtccactctgactaatttcactttcttactcatagatctcacctgcctgctcacgcttgtcattatcacttaaatagttagctagtaaataaaactggatcttaccttgaaaactcccacgaatatcgatatgaaatagttcctcaaatcgtttgattttatacactagagtatttttgtgtaaaaacaaactttctgctgtctgtgtcagattataatcattagtgtataaatgtcttgcaatactgatcagttcagcagtatcaattttgttgattcctccattaaaataatcaaacagattcgttacttcttggtgaggaactcgatttgctaggtaattaaggacgtagtcccaaaaatggtaaatcttttgtccttccattgcaaaatttctcttcagccaatatgtatgttgatagcttgactggaatagccgcaacttattttgcacactgcctacataaaaatagcagtcacttaatccccattcttgcagatcgcgaataaaactgttgagatagtctttgaccgtcagctccatcaaattttttgggatgactttaaacataattatctcattatctgccatcaatgagtaaatagtctcatcttcattgattttgtactttaagtttgtcacttcttgcacatcaaaagctgttcctttgactatacggattgctactcttggctttgttccatcaatgtgcagttcttgaacaagacgcagaacttcgtcaatgctaaaattcctcttggcaatcagtgctttgatcaattgttcttccaaacttaaactttgtctagcagcttcttgattcatttcataaataattcttgttttaagcgactctgacagcaaatttgccacaatacttaaactatcatcctgtccatttacccataaataaccatagtctttctcttcaacagcaattttatagaagtggtcgtctttaccttgttgacttaggtcgatcaaagtaccattttttcttttatcgctactggaaataacttttccataattatctataaggccaatcgtatatttggggttttcttgtacaacaaaaataaattctttaaaaatttgctccaaattcattatattcacctcaagctaaaaaatacgtatccagcataaacataacatttcttatcaacaaatttttaaagaatcctcacacttaatcaattaaattgtaatactttagcatagacaaaattttcctgtcatcggatgctgttgtttctttcactggtcgtcgagcgggacctacttcggcaatcgcagccaattcaattgctctttttaatattgaaggtactgttcctaattttaatgcaccacgtaattcttcaatgtcattttgtaatttctccgctgattcccagttattccctctgattgcctgatccaagctcacgatcgtttccgtgattaaattgcttgtaccagcaattgccccagatgcgcctagtttatagccggctaaaattttcgagtcagatccaaccaacacgttaacctttgtgccctcagttacttctaggtagtcctttaagttgttcaagtctccgctgctatccttgattcctaaaacattgggtaattttgtcaactctctcaaaacttctttcgaaatattacatccagtatttttaggaatattgtatagaatgattgggatctgtacactgttcgctaccttttgataatgctgcaaaatttcttcatcagatggggttataaaataaggcgttatgacagataaagcatcggctcccagtgactccgctttttgtgatagttcgatcgtttcttttgtagaacatgcgccagttccaatataaacaggtactcgttttgccacatgatcaatgaccgcttttgaaaaagccattttttcttctgaatttaacacatgaaactccccgttacttcctaaggggaatattccagacacacctttttcaatcagatgatccaccaagttttccattgcctcataattgatggtttcagctgtatctctatgaaaaggggtgacaattggggtaattattccttcaaacatcttttagtctccttcactcaataactgttcatttgttaaaacaacactttcttttgcaaccgtaaaacaactctcaacaaacgcatccagatcaatcgtctcggcagttgtgcctttcatatataaatcaataaacattggcaagtttacaccagtcaccactttatgctggtattttttggtcaacgccgtcagtacattggagggtgttcctccaaatagatcaactaaagcaatcgttggcccactaatggtttcaaataattcattggcttctgccaaaaagttttcaaaagatttatcgggaagcagtgataggctatagacattcaccgtctttcctacgatcatttcagccgaacgaatcaattctgcgccaaatgatccgtgagttgccacgactagattcaatttagtcattttctctctccttcatagtttagcaatttactcaaaacaatatccgttgaaatttcgcaagttctggcttcggattcaatcgttctggcacctgtatggggtgttagatagaagttttccctcgcaagcaatgggtcctcagatttcggcggctctgaactaaatacatcgaaacaagcactgcgaatgactttcccagctaaagctttagataacgcctcctcgtcaacaatgcctcctcgtgcagtattgattaaacaagcattatctttcattctgtttaattcagcagttgagattagatttttagttttttccgttaaaggtaaatgtagggagacgtaatccgattcctgcagcaatgtttccaatgctagttgctctgcatcatactgtttcagctcttcaaccggcacatcataaacgtcataaatccgaacatgcatcccaacaccctgtgcttgtcgtgctaactgtttcccaatcgcaccaaatccaatgataccaattgtttttccatataattctctgccggtaggtttctgccattctccttctttgacttcacgaaccgtttcataaatattttttgattcactgtaaattaacgccataacatgttctgcgacagcgatagaattagagccaatggttcgtccaacataaattcctttcgattccgcgtaagcaacatcgatgttgtcggttccgacaccgaatttgcaaatcacttttaactgtgggcactgatcgataaatgcctgatcaataagatcgacaccaacaataatcccatccgcatcctttgataattcaagaaatttttcaggtgaataagcttgaccagtgttgttataactcacttgaaatccgtgagaacgcagtttgtccaattccttttccccataatttgcaaaaccgcgaggtgtaatgactatcttcatttgcgttttctccaatcttccttacaaaataccaaaaaaggttagcgcgattgcaaagagcatcgtcgcaataatgatctgcaggtatttgggtccttttttcatgatataaaaatacattgccataactaaacagaaaggcagaaagctcggtagaataccgtcaataatttcttgaaccgaggttgtccctgtttcattgctaaattcaagaatcgtcgaaaaattgacatacgccgcagacagacacccaatcataaagagaccaacaatactcgcaatgtcgatgacttttttgattgatccagaattcaaaatatttaatacagaactctttcctagagtgtatcctttattaatcaaaaaccatgaccagccaaaactccatgcgatgtagataactcctgggataaatgctgctagaattgatccgttcaaagccataggtacaaaaatcgcgagtggtattgtagctacgataccttggtcgacgctatcaccaatccctgctaaaggtcccattaaaccaatttttaacgactcgatgacttcaggtgtaatctcttcatttccattagcccgctgttcttctaaagaaatgacgattccatgaataatacttccccaatcacaattcgtattaaacatttgtacatgtcgtttcatcgctgcttgtaattcttctgggtcatctttataaattttttgaagtgtcttatttaatgaatagctgaaagctaaagcctgcattcggtcaaagctaaccggaacctcgacagctaatgtccatttccaccatgcttttaacaaatccaatttcgtaacctttttttcagtagcaactgtcatttctgcactcatgcaaattccccctcatcagaattttgtttgaataatgaactaatcattgcaatacatacagcaaagactgcccctgtcaacattgagaatcctagaactgcatacataaagaaccctaaaacgaaaaatggtaaatattgttttttacccatcacgaccagagtcaatgcaaatcctaatgccggcaacattcctcctgcattggctaatccattcattaaccattccggaataacatttaagaatgcctgaatgacatttgtgccaaataaggttgcgataaataccggtgtaaagtatagaacaccgttcgttaaccaaggaatcacgaaagagaataaagacaattgatcatatttattcgcttcaaccaacgcatcagcacgcgtattataaaatgagttgatcgtacgacgaacattgttgatcaatacaccaagtacaccgaatggtactgctaaagcaactgctgcgctagcctctagaccactagctaaggctgctggaatagcgatacatgctgctaaagcttgatcgcttggaatattcccaccagcctcgatcccacccatgtacatcaactgaatcgttgctccatataatagtccagcttgaacatccccatatacgagaccaataaaaacacctaaaactaccggttttctaaaggcaaaagaaacgaagtaactcgcacgacccattgctaaccaataaattaaaccgactaaagctgattgaataaccatgttttcactccttactctttatgctaatttttttactgcattttgaagtgtttctgaagggtaatctggtgtcgtttgaaaatagacattgattcctttagactcaatcgctaataattgatcggcatctttgcgatcaagcgtaatggcattgttgactgcctttctaccagggcccccacctaagccgccaatttgaatttcgggtaatgccaaaccggcgttgatcgcattggtcaattcttgaacactttttagtaaaaccaaaatacgatttctctcaaattcgccattttcttgcgctgcgacagcttcttcgacagaaagaatccgaatccgaacccctttaggtgcagccattttaaaaacatcttgcataaactcatctttgcttagtgctgtatctactgtcacgatttcgttgatatcacattgctttagccagcgagtgatcacctgtccatgaattagtctaaaatctactcttgtcagtgcaatactcatatattttccccttttctttcctattacttagtaagcggtttctaattgttgcttgttaaatttcctttacccactcttttttccaaaactacttacggtatttttggacgacagtatgaatcgcttccgcattggtcctaatttctgccaccgttccttttgtcaataggctcccgataccacagacatcaacgccacgttgtagccatgtttctatgttctcaagattgatcccgccactagctaaaattggcatatctggaatcggtgttttaaagacagttactagtttagaaccataaaaatccgagattggaaaggctttgatgaaagcagctcccgcactcaatgaatcgacagcctctgtaaaggaagtacagcccggtgcataaggtatttggtatcggttacatatctttgcaacctcttttgaataattcggtgcaataataaactgtgcaccatgcagtattgcatgtctggctgtttcgctatcaaaaactgtccctgcacccacacataattgatccccatatttttctgtcaatttttttatgatgtcgccagcactattcaatgtataactcatttccatcactggtacaccaccggcgatacacccatcagcaatttcacacgctcgttcaaaggattccgtgcggacaattgctaatgcaccggtttgatagattctctgtgtaacactcatttttttcatcatttctcctcacctcacctataatttaaatcgaatgggaaaatattcatatgtttgaacaaacgaaaaaaatctccttttttggatgacagacacaatccacttgatacgaaagcgttttctatcgcttttaaaaaggtattttttagcaaaacaaccctgtagtagtggactttggaataaaaaattggaaatcgaaagaagccctgatcattaataaaggacagatttagcgtaaaatcgttcatttaaccgaactatctgaaggacaggttctttagcaaaagaaaaaaaccggaacagaagtcacacttctgttccggtttccactctatttatacagtttgatcagaaatcttttttatgctcactgaatcaatgacgcacacgtgattttgctggatcgatttgaggcgcttcacctaggtgcgcttggatcatccagatacgtttttcagtatctgttttgaagccgataaagatatcttgtgttggatcatcgccttcttcaccactgacttcaatccctttttggtataagtcagctagataacgataaccttcaacaagtgtagctaaacgttctgggatcgtacggtcccagttgccgatttcatcagggatttgtgtattgtctgccatttcccgtaatgttgagtatggtgagccatctaatgtgatcaagcgttcagagatcacatctaattgatcattcaagtcatccataaaatcatccatcattggatgtaaagttaaaaagccaggtcctcgcatgtaccagtgtgtttggtgaacgaccattgccatttgacttaagtcagcaacgagttgattcaacacttcttttgtttgttcaaatttcattacgattcctcctttaaattctctatttcaagcatagtatgaatctaaaaaaaagtacaccaaaacctactacttgagaaaatttctcagcttttcacgtatttctttatgaggcaaaggaggaggagacagtgtatctgatgtggggatatattttaggtgcagcggtatatgcgtttattcaaaccatttactggcaggatgatccaagcgaatattttgatgattttcatagaaaacctcctattttctattccgtggcccaacagccattttttccttttatcaagcatgctcaagttttattggattgcactgctgctagtttattggcaaaaagcgtttatgcttggctgatctggcttgctttcctacaaccatccgtaggggagtgttggctggcgttggtctggttgaacagtgcttacctcctcactttgacagatctctacgattatagtgtcaagggagagattctctatccttctttgtttttattggcttttaccaatctcatgaacgcacagccttttcattggcagaacttcctgctgcttctgccattattctttttcgtttggcaagaacagctgggagatggtgacttattcttgattggtggttgggcgccttggctgtctacttaccaactcctgtggctgttgattatcgctagctgctgcggactcttgtttttttcattgcatatgctgtttgtcagaaaccaattacgaatgctgccctttgttccttgtttgagtttagcattagtcatcgtgcgtttcctttaacaaaaaagcccgctgtttcattagcgaaacagcgggcttttgtttagttttggttgttcaatgcatcttctgcagccatttgcgcttcaatgtcggaaatactatagacattttcactcgcaacagtgacttcttttggttccatttcacggtagcgagccataccagtacctgcaggaataatcttaccgatgataacattttccttcaatcctagtaatggatctttcttcccgcggatcgcagcatctgtcaacacgcgcgttgtttcttggaaggatgcagcagataagaagctgtttgtttccaaggatgcttttgtgataccaagtaagactgggcggctggtagcaggaaccccgccggcaactaatgtgttgtagttgcggtctttaaagtcagcgatatccatcaatgttcctggcaagatgtctgaatcacctggatccatgacacgaactttacgcaacatttgacgaaccattacttcgatatgtttgtcgccgatttctaccccttgcatacggtaaacgcgttgtacttcacgcaatagatagttttcaacagacaagacgtcacgtacttgcagcaattgttttggatcgattgatccttctgtcaatggtgcaccacgatggataaagtctccttcgaccactttcatacgtgcggtaaatggtacagtataggtccgagtatcagtttcccctttgatcgtcacttctttcgtacgagtagacgcatcttcagagatatcgattacttcaccggtaacttcagtgatgaccgcttgacctttcggattacgggcttcaaagatttcttggacacgaggcagaccttgagtgatatcatcaccggctaccccaccggtatggaatgtacgcatggtcaactgagtacctggttcaccgattgattgggcagcgatcgtaccaactgcttcaccaacttcaacttctgaaccagttgccaagttacgaccataacaatgtttacatacaccatgttttgtattacatgtaaagacggaacggatcgaaacagtttcgattcctgcgtcaacgatttctttggcaaggtcttcagtgatcaattgatctggtccgacaatgactgcaccagtctctggatggatcgctgatttacgtgtgtaacgtccaatcaagcgttcttccaatgattcgatgatttcgttaccttcacgaatggcttgaatatctaagccacggtcggttccgcaatcttcttcacgaatgatgacatcttgcgccacgtcaaccaaacgacgagtcaagtaaccagaatcggctgtcttcaaggcggtatcggtcattcctttacgagccccgtgagtagagataaacatttctaagacagaaagtccttcacggaagtttgaaatgatcggtaattccatgatttgtccattcggcgcagccatcaatccacgcatcccagcaagctgagtaaagttggagatgttaccacgggctccagaatcagacatcatgaagattgggtttttcgcttccaatgattccatcagtttcaattggatctcatctttcgcggcattccagacaccgattacgcgttcataacgttcatcatcagtgatcaaaccacgacggaattgtttcgtgatcgtttcaacttgtttgtgggcattttcgatgatgtcatgtttttcatgcaagttcatgatatctgcaatacctacagtgataccggccattgtagaatggctataccctaagtctttcatgcggtcaagcatccgtgatgtttcagtgatgcggaaacgtttgaagacttcagaaataatatttcctaagtttttcttcttgaatggtccgactagttcttgttctttgatgaaagcaggaatatctgttccagcttcgacaaagtacttatctggtgtttggactgtcaagttgaaatctgttggttcattcaagtaagggaattctgttggcatgatcgagttgaagatcactttcccaacagtcgttaccatcaagcgttctttttgttctgcagtaaatggtttgtcccctaatgtgtttggattgatcgcaatacgggtgtgtaaatgcacgtaaccattgcgccaagctgttactgcttcgtccatgtcgcggaagatcatgccttccccttcgcggccttcttcttccatcgtcaagtagtagttccctaggaccatatcttgagatggtgttacaactggcttaccgtctttcggattcaagatgttttgtgctgctaacatcaacatccgtgcttcggcttgcgcttcttcattcaatggcacgtggacagccatttggtctccatcgaaatcggcgttgtaggcttcacagactagtgggtgcaaacgaatcgcacggccttcaaccaatacaggttcaaatgcttgaattccaagtctgtgcaacgtaggtgcccggttcaaaagaacagggtgttctttgatgacgtcttctaggacatcccaaacttcatcttcttggcgttcgattttacgtttcgcatttttgatgtttgacgcgatttcacgagaaaccaattcacgcatcacaaatggtttgaacaattcgatcgccatttcttttggcaatccacattgatacatttttaggaatggaccaacgacgataacggaacgaccagaatagtcaacacgtttacctagcaagttttgacggaaacgaccttgtttccctttcaacatatgagaaagagatttcaatggacggttacctggtcctgcaactggacgaccgcgacgaccattatcgatcaaggcatccactgcttcttggagcatccgtttttcattttgaacaataatattcggtgcatttaagtctaatagacgtttcaagcggttgttccggttgattacacggcgataaagatcgttcaagtcacttgttgcgaaacggccaccttctaattggaccattgggcgcaaatcaggcgggataactggaataacatccatgaccatccagcttggtttgtttcctgaagcacggaaagcttctaagatatccaaacgacggatcgcacgtgtccgtttttgtccggtcgcatttttcaattcttcttttagttcggccacttcgccgtctagatccacaccatccaacaattgtttgatggcttcagcacccatcgctgctgaaaattcttgaccgtattggtcacgtttttcacggtattcccgttcagtcaataattgtttcttctcaagactagtgtttcctggctcgatcacgacataagaagcaaaataaatgatttcttccaaggcacgtgggctcatgtctaacactagacccatccgtgaaggaatgcctttgaagtaccaaatatgtgatacaggtgccgctaattcaatgtgacccatccgttcacgacgaacttttgagcgagtgacttcaacaccgcaacggtcacaaacgattcctttataacgaattcgtttgtattttccgcaggcacattcccagtctttggttgggccgaaaatacgctcgtcaaacaacccttcgcgttcaggtttcaacgtacgatagttaatggtttcaggtttttttacttcaccgtaagaccagcttctgattttttcaggagaagccaaaccgatttgcatactttcgaatttatttacatcgatcaaaaaaggttccctccatttcatttcatggacatatccgatagaacacgaggttgagacctccgtctgattttgacgggtgtcccctcgtttctattattgcaagcgatcttctgctgtctcgatttgttggttcaaatcatcggcggcatttttagcttctgtttgtgcttgttgctcaatttcacgagcattttgttgttcggcaaattttgttaaggcgtccacggtgatcaagtcatcatcgtcatcatccatatcacgcaattcaatctctgcatcatcaatgtctaagacacgcatgtctaaaccaagtgattgcaattctttgactaatacgcggaatgattctggtacgcctggttttggaattggttcccctttaacgatcgcttcgtatgtcttcacacgaccaacaacgtcatctgacttgtacgtcaagatctcttgcaaggtataagcagcaccgtatgcttccagtgcccaaacttccatttccccgaaacgttgtccaccaaattgtgctttaccacccaatggttgttgcgtaaccaatgagtatggtccaattgagcgggcatgtaatttatcatcgaccatgtgagccaatttgatcatatacatgacacctacggagattcgaccatcaaatggttctccagtacggccatcatacaaaacggttttggcgtcgctagccatgccggcttctgcaactgttgcccagacatcttcatcgctggcaccatcaaagactggtgtagcaacgtggattcctaattggcgggcagccattcctaagtgtaattccaatacttgtccaatgttcatccgtgaaggcacccctaatgggttcaacatgatatcaactggtgtaccgtctggtaagaaaggcatgtcttcttctggcataatgcgagaaacgacccctttgtttccgtgacggccggccattttatccccttcatggattttccgtttttgaacgatatacacgcgaacgagcatattgacacctggtgacaattcatcgccagcttcgcgggtaaagattttcacatcatggacgattccaccaccaccgtgaggtacgcgcagagaagtatcgcggacttcgcgggctttttcaccaaagattgcatgaagcaagcgttcttctgcagatagttccgttacccctttaggcgttactttaccaaccaacagatcgccatctttgacttccgcaccaatgcggatgatacccatttcgtctagatctttcaatgcgtcttccccgacattcgggatttcacgagtgatttcttcaggtcctaattttgtatcacgagcttctgattcatattcttcaatatgcacagaagtgtagacatcatctttcaccaaacggcggctcatgatgatggcatcttcatagttgtacccttcccaagtcatgaatgcgactagaacgttttgtcctaatgccatttcaccattttccatggatgggccatctgcaaggatgtcgcctttttctactttttcgccaagggctacaagtgggcgttggttgtaacttgttcctgagttagaacgacggaatttcgttaccgaataaacatctaatgcgccattgtcgcgacgaacgcgaatttcagcagcatccacatattcgacgattccatcttgtttacacaataatgcagcacctgagtcatgggctgatttgtattccataccagtaccaacccatggtgatttagggttgatcaatggaactgcttgccgctgcatgttggcacccatcaaggcacggttggagtcatcgttttccaagaatgggatacaagctgttgcgactgcgactacttgtttaggtgaaacgtccatgtagtccactttgtcgatcgacacttctaagttttcagaagtcgcacgagccataacaacatcattcacgaatgtaccgtcttcattcagcaaactgtttgcttgggcaacgacgtaatggtcttcgatatctgcagtcagatagtcgatttgatctgtcacacggccagtctcccgatcaacacgacgataaggggtttcgataaagccatatttattgactttggcataagacgccaagctattgatcaacccgatgttcggtccttcaggcgtttcgatcggacacatccggccatagtgggaatagtgaacgtcccgtacttcatatccagcacggtcacgcgtcaaaccaccaggtcctaaggctgataaacgacgtttatgggtcaactcacccaatgggttggtctggtccatgaactgtgacaactgagaagaaccaaagaattctttgatacttgctacaacaggacgaatattgatcaattgttgcggtgtcaatgtttctgtgtcttggattgacatccgttcacgaacgacacgttccatccgagcaagtccgattcggaattgattttgcaataattccccaactgaacgaatgcggcggtttcctaagtggtcgatatcatcaacattgccgataccttccattaaattgaagaagtagctcatagaagcaatgatatccgctggacgtactgtacgaacggtcgtatctggatagccattaccgataacattcacttcttgttctggatcttttggtgaaaagactttgatgacttgaacagtcattggttctgtaacaacaccgtcttctgatgggtagtaagtaacactatttaaaccattatcgataaaggcacctaatgtttccatcacttggtgagtcaacacagttcctttttcgacgatgatttcgccagtttcaggatcaaccaatgtttctgctaatgtcaaattcaatagacgtgttttcaagtctaattttttgtttactttgtaacgaccaacatttgctaagtcatagcgttttggatcgaagaagcgagcattcaacaagctgcgtgagctgtcagccgttttgggttcgcctggacgcagacgttcgtaaacatctttcagtccttcttctgtccgagagtcgcttgcatttttgtgcaagtctttttcgattgtgttgcgtaacgaatcactgtctccaaaaatttcaaagatcgtgtcatctgaaccaaaccctaaggcacgcactaacacagtcaaaggaatcttccgagtacggtcaatacgtacataagagatgtctttcgcatctgtctccatttctaaccacgcaccgcggttagggatcacagttgagccgaatccttcttttccgttcttatcgactttcccatggaaataaacacctggtgaacggactaactgagaaacgatgacccgctctgccccattgatgataaacgtaccttgttccgtcattaatggaaaatcgccaaagaagacttcttgtgacttgatttcgccagtttcacggtttgttaaacgcaatgtgacatgcaaaggtgccgaatagttggcatcatgtgcacgagcttcttccactgtatacttaggttctttcaattcatagtctacaaattctagggacaaattgccgttaaatccttcgattggcaaaatatcttcaaacatttctcttaggccctcatctaagaaccattggtaagagtcggtttgaatttcaatcaaattcggtaattctaatacttcactgatccgtgcgaaacttctacgttcgcggtgctttccgtattttactacgtgtccagccaagctcttcacctcttcataaagtctttcaaaaaggctatccgattatttacaaaactgtaacaaatattaaatatatattacagaaagcattttttgcggcttttaggcaaaaaaaaaccaaaaatagaacagatgcaatgggcattttctacttttgtttccttattcccaagccgaaacggacaatatttcgtttctgcttttttctttcagatagtttttgcaactccctattatacagatgaagcacattgatgtcaagctttcattgaaagttgcaacgcttttccgatgcatgcaaattctaagttttctttaagaaaggattctctaaaattagaaaaaatgacgagaaatttctttgcattttcttgttttcttgctatgctagcaaaaaaagcatgagcgttacacgtgaaacattttgaaaggagcaactatgacaactagagaaaagattttggcattgttgcaacaagaaacctccgttttatccggagaaaaaattgcccaaaaattggacatatcacggactgccgtctggaaagcgattaaagaattagagaaaaaaggctaccgctttgaacattcagccagcggctatcgctatttatcagcagatcgttacgaacaacgcacgttacaggaagcactgccgatggtagcaacgatccagatcgctgaccaagttgagaccacgatgaaagaagcaaagctagctgctttatctgaactttcgactccggctctatttttagcagaaacacaggtaggcgggcatggtcgattcaatcgtcctttcttttcacccaaaggaaaaggaatctatatgagcttattgctgaagccaaatcataccttcagcgagttgcctcaatacacattattggcagcggtagctgtggcacaagcaatcgatgagttgaccggcaaagaaacacaaatcaagtgggtcaacgatatttacttagaaggaaaaaaagtctgcggtattttatctgaagccactagtgactttgaaagtggccgcatcgcttcgatcgtcatcggcataggcatcaactttgcgatccctcagacagctttcccagaagatatccagcaaagggcaacctctctctttccaactggggaagctcctgtcaatcgtgcgcgcttgatcgcagcagtatggacacgcttctttgacttgttggatcaattaccggctgatgattatctaactatttatcgtcagaaatcatttgttcttggtaaaaccgtttgcttcacacaacaaggcatccgctatgaaggagtcgcagagtccatcactgctactggtgaattagtggttcggacaacagatgatgtcaaagtcctttcttctggtgaaatcagtctggagaaatattcttagcagcatttttttcaaaaaaccaaacaaagacccgtcagatcaagaaagactgctcttacgatgcagccattctttgtctgacgggtttttgtcttgctatttagtgaacgagcatttgccagatcaggcataaaattaggcctagagcatagctactgttaaataaaatcatgtttttgattgaataaccaaagcttcttgggtgaggcaaacttgcttgatgctctttcaagttttggcgaatcttcggtaaggttagaaagacgagtaagatcggccactgataaagaccaaacaaaaatccgatcaaaatcgcaccgtaggatgccagcatcaatccttggaaaagatgaatgccgttggtccgaccaatgtaataaaccaatgtgtaccggtggttctcaatatctgtttctaaatcacgcaagttatttgccaacataatattggcaatcgtaaatacaaggggcaaggatgctaatacaatggcacataccgcccacagatgacccactaatccgaaggttccggtcgcaaaatcaatgtctaaataaaaaactttttgtgtgacagtgttcagatagatggtgatggcaaaaatacctaatcccatcgtcattccactaaagacttcccccaatggcatccgagataagggaaccggcccaaaggtataaaacaccccgataaagcatacgactaatcccatcagcaataaaagccagcctgtcatccaagtcagataaagaccgatcaacaacgttagcgccaacatgccaaaaatcatgttccgtacaagggtttcgggaatcttttcccgaccgatcacattttgttcatacttataaaccttagactttgcttttttgaaatccatgtagttattgatcgatgttgtcgttaaatcaaacaagatcatccctacaaaaaatataacggtgttcaatggatggaattcatggaagtatacgagagaaaacaagattcccataataaacggaaaaatacttgcaaccttagtccgaatctcaacaacttctaaaaatactgcaagagacacaagatccctcctcttattttaaatcggcacgatcgcccatcgtgtaacctgattcttcagacagcttaaaggtatctttgattccatccgtaacatagacgatcccttctttcgtgatgaagatcgcatctgttcctttgtcggtgtgctgctcgatatattctaaaccagctttgatccctttatcaaaaaccaccgtcgtcaaaccatcgccatcgatcgatttatctgtgatcacagatacactggcaatgtcattgtcatacggataccctgtttctgaatcaaagatatggtgataggttttgccgtcgactttcaaatagcgttcatagattcctgaagtgaccaccgttttgttggtttctttgatactgccaataatggaaccgcgggcttcgttgggatcttggatccccacattccaaggttcgtcttcaccacgattgctatgtcctaacacatagacattgccgcctaagtcaacgattgccgaggtaaccccttgttccttcaatactttgactacttcatccgtgatatatcctttagcgatcgctcctaagtcaatgatcatatctttgtcttttaaatagacggtcttctcatcatcattgaactcaactttccgataatcgatatgttttagtgcttcatcaatttccgattgttccggtttgcgagcatcatcaaatccaatccgccacaattgggtgatcgcaccgatagccatattgaacccgccattagattttttgctatagtcataggcatccttcaatagaaaataaatatcatcagaaactttgactggtttgattccagcttgggcattgatctcgtcaacttctgatcctgcttggttgatcgtaatcttgtctcccaattctttgatgcgggcaaacgctggtttcatcgcagattctttgccttcatcgtaaattctgatgcgtgtatacgtgcctaataaaaattcttcttgaaaatatggttcgtctcttaattgaacagtttctttttcactgccgcaagcggataatattgtgataaaaaaaacaatcaatgcaaaaaacggtaatttctttttcatggtcttcctcttttctgttgtattcaattttattataatagctttttttttctaaaatgaaaagggttggcgccagaatcttagtttcttttgcgattctttaatctcttctgtttctttatcagacagagggagtccacgtaggaaggttttctactagaatttttttattattggtaggttatttagcgcttttgaacataaaaaaagcggtactctacatcagaataccgcttgttcatttatgaattattcagtgacgatgttgtccacttggataggtgtttcgtcccctttttctgctgcgttcaacaattgttgtgcatagatcacgaagctgtggaagctgtgtgtcgcaccagaaacaacatccatatcagcaactgaaccatcttcagcatttactgctgtcacgaatgcttcgttgaagtttggaataaattcttctgggtttgtaccagattttgctttcatgttttcgttgtattccgcatcatcttttttagatttgccatcttcgttaacatagtcatagttagattcagacactttgccgtctttgacagtgattgagaatgctacacggtagccatttgaatagttcttttcttctaagctatacgtaccatctttcaagtctgcaccgttgtcgatctcgattgtatctgtgttgcctgcttgagcagcttggatcaattgttgtgcatagttttggaatgaatcgaatgagtgtgtcgcaccagaaacaacttcaattgctgaagggctttgtgccgcaaccaattcttcattgaatttaggaataaattcttctggactgattcctgctttggctttcatgttttcgttgtattccgcattttttgtttttgattcgccgtctgcattgatgttgtcatatttagattcagtgattttgccatctttaacagtgatttcaaaaactacgcggtaatcatttgaataatttttttcttctaatttatatgtgccatcttgcaatggtgctcctgcgactactttcgcttctgattcagaagttgctgttgctgattcgctgctagcgacttgtgaagtactttcttttgttgacgaagaagctgacgtgttgttgtcagatccacaacctgctaatactaacgctgagaatgaaaataccgccatacctaccattaatttctttgctttcataatgctccaccttttactaattattttcccacaaaaaaagtttgtgattcatctaacattttaaagtaaattagaaatatgtcaaccgcttccctatagcttttgtgaatatttttgaactttttttgattttcgcaaattttcacgaatttcatgaaatatcgtattttcctatcagaaaagttagacaaacgatggatttctatatataataggaacgattgtgtatttattatcatagattattttttttaaggagagatttgcaatggcaaagaaaagcattgtcgttgtcggtgcaggctatgccggtgtttcagcaaccaagtacatggcaaaaaaattgaaaaaagacaatgatgtagaaataacattgatcgatcgtcactcttatcacaccatgatgaccgaactgcacgaggttgccgggggacgtgtcgagccgaccgcaatccaatatgacttgcaacgtttgttttcacgtaagaaaaatgttcgcttagtaaccgacacggtaactgctatcgataaagaaaagaaagtcgtacaaacaaaacaaggcagctattcctttgattacttgatcttaggtatgggtggcgaaccaaatgacttcggcactccaggagtaaaagaacacggatttactctatggtcatttgaagattctgttcgcattcgtgaacacatcgaaaaaactgttgctaaagcagcaatcgagcctgatgcagcacttcgtaaagcaatgttgactttcgttgtctgcggttctggctttaccggtattgaaatgatcggtgaactgatcgactggaaagagcgtttggctgaagactacaaattggatccaagcgaaatcactttgaaagtggtcgaagcaatgcctacgatccttaacatgttggatcgtaacgatgctgccaaagcagaacgctacttgaaacaaaaaaatgtcgaattagttctgaacgcaccaatcgttgaagtggctgaagatcacatcaaattaaaagatggttcaacgatcccaacttatacactgatttggacagctggtgtgaaaggaacgagcgacgctgcagactttggtctagaaactgctcgcggtttccgccttgttgctaacgaatatatggaagcaaaaggttatgaagacaaaaatatctatatcattggtgacttggtcttctatgaagaatttccaaatacaccaacaccacaaatcgttcaagccgctgaacaaactggtcatacagctgcatcaaatatcgtcgcagcgatcaaaggtggcgaaaaacacaaatttaaaggaaattaccaaggattcatggtatcgattggcgctaaatggggcgtagccaacttattcaataagattcaccttagcggtttcttagcaatcattatgaaacatatcgtcaacttgaaatacttctttgacattcgttctggctactacatgttccaatacttgatgcatgaaattttccatatcaaagatgatcggacagtggcgcgtggtcatacttcacgttacggaaacgttctttggagtgttccactgcgaatcttctacggtctggtatggttcgttgaagctttcaagaaaattctaggtacaaatggtgaagtctttaagccaggaacttggtttggcgaaggttcttggttccaaggaaacagcgtattcccttggacttgggaatatcaaactgttgctgatgcagcaagcggcgcgagtgaagcagctgacgctgccagtgcggcaagcggtgcaggcgatgctgccggcgcagtagcaacccaagcagctcactttggtttaagttatgcctacggcgaacaaccaatggtcgtgatcgaaaaatcaccagattggtttacaaaagtgatgcaatttattatgcctaacaacgatgtagcaatgttcttccaaaaattcatggtcttctttgaaattgctttagctttagcattgatggctggtttgtttacttggttagtgaatgcaacgacaatcgttttagtcttgacattctgtatgtcaggtatgttctattgggttaacatttggttcatcccagtagcctttgcattaatgaacggttctggccgtgccgttggtttggatcgttgggtgatcccatggttacaacgtacacttggtaaatggtggtacggtacaccgcgttccttatacggtaaaaaataatcgctttataaacgagactgaggcagcctgatcctttgatcaatgtctcagtctctttccaagttaagcactttttttatctactagaaaaaccttctcttaaaagtagtagaaaaccagcggattatgctagaatgagacacagaacttcaaaggagtctttctgatgaaagtaaaagaatttatccgtcgtgcccacctgaagccttgggacggggtcatcattctggtactgatacttagctcgtttttaccaattttgatttttgggcaatcacaaagtacccctactgccgccaaacaagctgttttgcgagttgatggcaaggagatcaaagagtttgatttgatcgaaggacaagatagctacacgtatcgatacgaagatccagatggtgattacaatctcattgaaatcgctggtgaccgcatccgcatcaaagaagctgactgtggcgatcaaatttgcgtccgccgcggctgggcctcaaaaaatggcgaaacaatcgtatgtttgccacataaattagtgatcgaagttcgtgcaacagatgggagtgagacagacgatctaatctactgatcgtgatactatgagtcgtttacagaaaatcattttcatctcattattagttgctcaaggagtcgttatcggtttgattgaaaatatgattccgtatccttttgcctttgctcccggagctaaattaggtttggccaatctgatcacgatcattgctttgttcactatgcctaaacgagacagttttttgctgatatggctacgtttaatcttaactacactcttaggcggaactgtttcaacattcttatatagtatgagtggttcacttttgagctatttcggtatgttgctagtaaaacaactaggacctaagcgcgtcagcattatcgggatcagtgcagctggtggttttttacacaatgttggccaattggtcacagcttcttggattgctcaatcctggagtgtcatgctttacctacccgttctcgcatttttcggtattctatcagggatcgccatcggcatcgccgccaactatcttttgcaaagagtagacacattacggcgatttcagcttgattatgaacggcaaaccaatgtcaagtggcgttctgattcaaaataaaggagtcatttatgaaacttcatccaatgtggcaagcatatcctgcgttgcaaaacgatttatctgaatcgctgcaattaatggaacaatccttgaaactaaaaaataaagcagtagaacaagcgatattagcgatgatccattctggcggcaagatgctccgcccggcctatcagttgttgttctctgaattcggagaagagaaagattctcaaaaagcagtagcactatccgcagcgatcgaaatgctccatactgcttcactgattcatgatgatattgttgatcaagccgatactcggcgaagcttgcctactatccgtgcacaattcggtaatgatgtcgccgtttacgcgggtgattatctctttgtatgctgttttaaactaatggcggattacgctggttctctcaaaagtctgcaaatcaattctcgcagcatggaaacaattttagctggagaattaggacaaatgagcaaacgctacgacctgaatgtgacgattgaggactatctggaaaacatttccggtaaaacagctgaactgtttgctctaagctgctttatcggggcttatgaaagtggggcttctctacgtttagccgatcaggcaaaaacgattggtcaatccatcgggttagcatttcaaatcatggacgatatccttgattacagccaaagcgaaagtgccttgggtaagcctgtccttgaagatgtcaagcagggggtctactcactgccgttgttgttggcactgaaaaaagagcgggcagtgctaacaccattactggagaaaaaagccgagatgaccgatcaggaagcgcagcaagtctaccaaatcgttcacgacagccatagcgttgaagaagcacatcaattagctgctcgttatacaaaaaaagccctgcaaggaatcaagaaattacctgatcctggaaaaaataccaaagactatttgtatcagatcacaaaccaaatcctagctcgcacaaattgagtggtttttctataaataatagtttgataagtgatttagaggtagctgctttcaactagctgtctttcagacaaaaaagaacgatctccgattgattagacgacacgtcttctataatcggagatcgttctttttctttacttcactttctcttgactgtttatcgcattgtaacgaactcttctgctccagtcggatggattgcaacggtattgtcgaaatctgccttagttgctcccattttgatggcgacggcgaatccttgcagcatttcgtcaacaccaattccaataccgtgtagaccaatgatcttctcttcttttcctaaacaaacaagtttcatttcacatttttgacgatagtcattcaatgcaaagtacattggtgtaaagcgtgaacgatatactttgatttcttcttcgccatattttgcgattgcagcttcttctgaaagaccgatcgttgcaattggtgggtgcgtaaaaatgactgtcggcaccaaatcataatctaaatgtgcctcagtttgaccattgaacaatcgttcagacaagcgacgacccgctgcaatcgctactggcgtcaactctaatttgccgatcacatctccaactgcaaagatcgattcagcagtcgtattttggtacttatcaacaatgacaaagcctttttcatctagagagacatctgtattttccaaaccaaggtgttgggtattgggcactcgtcccccagcaaacaacacacagtcccccgtcagtgtttgaccattttcaaagaaaaccgtatattgtccatcacgttcttcgatcctttcagctacatagccggaataaaggtccattcctgcttctcgataaatttctactaaattgtcagttaacatatgatcaaacgcccgtaatggacgttctttacgataagcccaagaaacgtgactgccaaattgctgactcattccgctaagttctgccgcaatgtatcctgctcctaagacgatcatttctttaggcacttcttttaaggcaaaaaagccattggaatcaatcgcatgttcaccaccaggaatcgacatgacactaggttttcctcctgtagcaattaagatctttggcgctctgtattcttgtccatcgaccgtcacagtatggttatccacaaactgtgcataaccgtggataacttctactctgttgctatctaagcctttttgatatgctgtgtgtaaaaaatcaatatatttttcacggttatccacaagttgcttgaaatcaaatttatccacatgtggataaataccatagctcgtggcatcacgcttaatcatttctaacatttcacttgcttgccacatcacttttttgggtacacagcccacattgacacaagtaccccccagctcattgccttcaatcaataaaactttagctccatgcattcctgcacggttagcagaagcaatcccgccactgccaccgccaatcactatgtaatcatactcttgcattattggtctcctccttaggaacaacttcattttggtgtatatcgaaggatttttcaaatcttacaaaaaaatgcgacagaaagcaccgagtcaatgataaagggagaggaacataacatgtacgaaattcaaactcgcttttagcacagtgcgctacccctcgaatctcattatttttcctttatcagccttggatacttctgtcacagtttttattttttcttccggatcatgtcgccaacctgaacaggttcagcgacgggcatcgttagaagcatcatcggatttggcgcgcgatcgatcgattcaccgtcttcattatacatgacttccaccttttgatggaaatgatggaatccaggtccataaaactcgatctcgtcccccaccgaaaacaaattccgctgccggatcgtggccatctttgttgcgtcatcataggccatgacttccccgataaacttgtattgcgggattttacgccgaggaccaaataattgctcattttcactcggtgtatggtaataaaatccggtagctagttctctttgcgctaccttccataattcatcaatccactcttgtttgcagacatagttctctggatcttccatataactgtcaactgccgctttgtacacattcgcaacagttgaaacatagtggatcgatttcatccgtccttcgatcttaaaactatcgacgccgttttcaatcaagtcaggaatatgttcgatcatggacatgtcgactgcactcattgagaattcttcttcgatcgttccattctttgtcaaactctttctttcttgtgcaaaaggcatatcaaaaagatcatatttccaacgacaagattgtgagcaaccaccacgattggcatctcgcatcgacatgtgattggacaatgtacaacgtccagaataagagatacacatcgccccatgaataaaagcttcaatctccacactcgtatttttgcggatttcggcgacttcttccatggatacttctcgagccaagacaactcgctcaagcccttcttctcgccaaaattctagtgtttcataatttgtcgcggaagcttgcgttgaaagatggatcggcaatcctggtgcttctgtcgcacagatctcgatcaaagcaggatcagacacgatcaccgccgaaattcccacatcccgcaattgacggaaaaattccccagctccttcttgattgccttcatgggtgaccatatttgctgctacatatactttagcattatgagctttagcaaatgcaaccccttcagccatctcttcataggtaaagtttccggcacgactgcgtaagccataggcgttgccgcctatataaacagcatccgccccgtaatgaatggctgtttttaatttttctaatgtaccggctggtgccaatacttctggccgtttcaatttttgtttgactgtcatttccattgctccttacttgatatcctctggattgatcgcataaaaaccggtatctaacccccgttgagctggatgtagctgacgtacttgttcactcaagctagctgcttgttcagcagtccatgtgccttcagtaagcaactgcttcgcctgtgcaaaacaagctacgatcgagacaaacgctgtccctggagtaaataaaccgtctaacttccaagtctgataccccgtttcaaaaagagactgcaattcattcatcaaattgatgtcattattggcgaaaatatgcgtgccatgactgtcttcataaatcgagtagtgggtatcctccttcttgggttctgataaaaataaacctcgctcacgagatttttcatcttcctgttgcgtataattataataattttgaagcaatggacgtttcgactgatggatgcacgttgccccatagacaagcacttccgcaggaatcgttagctgtggtgctaaaactgtcatttctccaaaggggacttctcttgctaaaactgctccaatcgcccctttttgcccccaaaaattgatttgtctagcactggtgaccagcgtctctccatcgtatacaaacggcaatgccaattccggattctttttcatacgataaatgattcctggatcgccgatagaaattttatcaacatggttggccttcaaaaaagccaagtattctggaactagcgtcattttttgcgggtgcatgatgccattgactgccgccatcgcttgttttccttctgcttgcgctaagcggatcaattcgctttgttcctctcgtgagaaagatgtcggcaaacgcaaaccgaaagtttcttctccgaaaaaaatagtatctacataaggtaagagctgttttgcttgttcgatcgactccaccgttgcgataatctcaaccatgatattcctcctctataactcactaatagtatcacaggcaacacggctttccaagacttccttttgaacttttttcactaaaaaaaggaatactcagcgatgagaactggtaatacaactttaacactcttttaaatttgtgaactttatgagtttttatctccagttcaattgttcgaattccaacaaatactatttgcccacaaaaaaactatccaagcagcaaacgatggttcagcctgcattctgctgaccatcagtcgtttgctagttagatagttttatttttctttatgagcttatacttgttgaagaatacgagattggccttcttttacattcaatgtaattgagcctttcgatgccccaatcgtcacccggtcacctaaatggatttgtcccgacaatagtgcctcgcttaagcggtcttcgacctctttttgcaatgctcgacgaattgggcgagccccatattctggatcaaaaccagctttaccgatgacatcaatcgctgcagatgtgatcttcagttgaatgtcttgatcactgagacgtttgatgatcgctttactcatgattttaacgatttcatgaatttcatcttcacctaatgaacggaagacaactgtttcatccacccgattcaagaactcaggacggaatgctttcttgagctcttccagaatccgtttttgcatcgcttgatggtctttgctaagatccaccacattgaaacctacattcttttcttcacgaatctgttgtgcgccgatatttgaggtcataatcaggattgtattacggaaatcgactttccgccctttggcatctgtcaaatgaccatcatcaaggacttgtaagagaatattgaagacatctggatgagctttttccacttcatctagtaaaatcactgaataaggttttgaacgaatcttttcagttaattgtccaccctcatcgtaaccaacataaccaggaggggatccaatcaaacgacttgtactgtatttctccataaactcagacatatccacacgaacgagtgaatcctcactgccaaacattgcttctgccaaggcttttgccagctctgtttttccgacacccgtaggacctaggaacatgaatgaaccaattggacgattcggatcttttagaccactacgtgctcgacgaatcgaacgtgcgactgctttcacagcttcttcttgaccaacaactcgctgatgcaggattttttctagatcgagaagccgttcactttcttttttctccatttgctgtaaaggaacgcccgtccattgcgacacgactgccgcaacatcttcgccagtgacactgtctgcgtagccggaagcttctttcacttccatgaatgcaacttcagtcaactgctgggtcaatttcttctctttgatgcgcaaacgagctgcagcttcaaagtcttgttggcgaatcgctgcttctttttcttcaatcagattggcgatttcattttgcaaatcggccaactcagaactttcgtctgttttatccaagcgcacttttgctgccgattcgtccatcaagtcaatggctttgtccggcaactgccgtgaattgatatagcgtaccgacaattggacagcggcatgcagggcatcatctgaaatctctacgccgtgatgctcttcataacggggacgtaatcctcgtaaaatttcttctgcttcttctggcgttggctcatccacttgaacacgggcaaaccgtctttccaatgcagaatctttttcgatatacttttgatattcatctaaggtcgtagcaccaattgtttgtaattctccgcgggctaatgcaggttttaatatattcgatgcatcgatagcaccttccgcaccaccagcaccaatcagtgtatgcagctcatcaataaataaaatgatctgtccatcttggtaaatttcgtcgatgattttcttcattcgatcttcaaactcaccgcgatatttcgtgccagctactaaagcacccatatctaacatcattaagcgtttgttctgcatatcttctggtacttcaccgtgaatgattttttgtgccaatccttcagcaatagctgttttaccaacccccggttcccctactaaaacagggttgtttttggtccggcggcttaggatttgaatcaatcgtttcacttcttttgctcgacccactactggatctaagcgtttatctcttgccaattttgttaaatctcgagctagtgagtccagcgtcggcgttccttgtgcttttccttgaggacgacgacgacccgcaccaccggcattttttgtgtcattgatacccatttttttctttaataactgccgcattttagccaaactcaaacctaagttcaacatgattcttgaggctaaaatatcttcatcccgaagcaatcctaacaaaagatgctctgtgccgatttgaagagcgcctaaacgcttagcttcatctccagcgtaagcaaatgtttgcttcgctcgtggggaataggctagataggcattctctggatattggcgaacagttccgtaacctgttaaatgctcgatttcttcgcgaatatcattttcagtgatattcatttcccgtaacgttttgccggcaatgccattttgttcaatgactaaggcaagcaagatgtgttctgaacctacggactgatgtttaaagtactttgcttcttcctgtgcgatcgtcagcacagctttcgctcgttgtgtaaatagttcatccatctcattcacttcctgtcttcataacttaaacgttctaaaattgcatggagcaagtctgctcgtgttcgattttcataaggagaacgtcctaatactgacttcgcaatgacggtcaacaataaattgccctcacgcttcgacaggattccttcctcataaagtttttggattattgcataagcatctttttccgagatggtttcatcaaataattgattcatttcttcaaggtagtggtggttatccgtgatctttactttttcgatacggatatatcctccgcctccacgtttgctttcaacagtataccctctttgaatagtgaaacgggtattgatcacataatttatttgtgaaggcacacaattgaataaattcgccatttcagctcggcgaatctcgattgtttcgctgtcttcaagaattttcttcaaatatgcctcaatcaaatcggaagtgttatgatgattcaattcattccctcccttgactaattctgaccttcattatacccaatttttgaaaacttgaaaagatgtacgcctagagatgcggaattactaaaagaaacttaaacagctagctcttttttcgcatcacaaaaaaactatccgcatcttcaagtggttacttctacagtctttggttgccatctcactgcgacctatagagtaaacttaaaaatcattcggatagttttttcagctattgattaatcttcagagctcgttgaactcgtacttgttgattcactgctagcggaggattcactcgtagaggactctggttttggtcctttagaaatagtaacatttactgaagaaccaacagccaccgaagtcccttcacctggcgaaacatctgtgacttctccagccggaacagaatcattgtagcccgattcttctttgatcgaatattttaacccagcctcatttagtgctgctacagcatcatttcgactctgtccaatgattcgtggcacattaaccatctcttgaccgctgctgactgtcagcgtgataacagtttgagaggtaatgactgattctcctgctcctggcgcttgattaatgacagtccccaccggttcatcgcttggcgctgattgttcataaatattttcggttggaactccttttgaggtcaatgccgcccgtacatcttcgattcgctgaccataatagtcttccattgcaaacgattcaggtcccgtgctgactacaaaagtaatgtcatcctctttcggagaaactttctcgccgacatctggtgattggctaatgatcagaccttctccgatagcatcactggatttggtctcttctttgatttggtcttctgaaaaacctaacttgatcaactcggcttttacatcttcaaaatttttctcttcatagttttttaaggtgattttttcagtccctgagctgatatacaaagtgatctcgctattttttttgacttcggttccttcttgtggatccgttttaacgacattgccttcttcaatctcatcgtcagcaatttcttcggtttcatcagcaacttttaatcctgctgcttccagcttttctcgagcaacggtctctgtgtctccgctgactttagggatctcaacatcgccgcgccctccgccaaaaacaaaatagccgccaatgaccagcagcgctgcaataactagtattggcaggatcagccaccatttcttccgcttcttctttggtttttcttgtttctggtctgcggtctcttctacttctggctccgtcactgccggttctgcaggctgttcagctatcatttcatcggtaataggggtcagcgctcgagtttcatcgtttagcgcatgtggctcccaccttggttcattcaagcgctcaggtgacagggctgttgaaagatcttctcgcatttcatcagcggtcttataacgatcggcttgctctttcgctgttgcctttaatacgacattctctaatgattgaggaacatttttatcatagatacgaatagaagggatctcatcttgaaaatgttttaaggcaattgtgacagcggactcaccatcaaaaggaactttccccgtcagcatttcatataggatgattccaatcgcatagatatcagattggttagtagccatacttccccgtgcttgctctggcgataagtagtgcacagagcctaacatcgagttggtttgggtgatcgatgtttccgataaagcaatcgcgatcccgaaatccgtgatcttaacgacgccttcttcattgatcagaatgttttgtggtttcaagtcccgatgaatgattcgatgttggtgagccaatgccactgctgacaaaatttgttgcacgatatcgacaatctgtagataaggaactgggtaatgggtttgaatatatcgcttcaagtccatgcctttgacatattccatcaccaaaaactgcatcccatcttcttcgcctacatcatacactgttacgatattgggatgaaccaactctgtggcagccaatgcttcacgctgaaagcggcgaatcgcatttttatcattttggaagtcaaatcgcaatactttgacggcaacttctcgatcaagaatcaaatcatgagccagaaatacatttgccatgccgccactgccgatattgccaatgattttatagcggccatttaactttttccctatttcaatcatgggcagttcctccaactttgatcagtaacactgtgatattatcgactccgccttgttgattggctgcatcgatcaactgctgaaccgcttctttaagggacgacgcgccttcaatgatggctgcgatcttttcatctgccaacatgtttgtcagtccgtctgagcaaagaagcaagtaatcactttcagcaaaataatgaatcgctacatctacttctactgtattaggcattccaacagaacgagtcaaaacatttttgcgtggatggttcagtgccatttcagcagtaatttggccagatttcaccaattcattgacaagagaatggtcttcagtaatttgtatcaactcatgatcccgcaaaatataggcgcggctgtcgccaacattcgcaatcgtaaattgatcctcaaagagtgctacagcaatgatcgttgttcccatgccattcagcgcctcatcctcgatgcctttttcatagatcgagacactttctgcctggattttttggatcagccattgagcagccttttcactatctgtcaattctgttttttcccaagcggttcccaagccactcacagcctgacgactcgctacatcacctgcccgatgtcctcccatcccatcagctaagatcgccaatgggatactttttttgttgacatacacagcagcaaagtcttggttcgtattccgacgtttaccaacatctgtttgaaaatggatttccaacttcttttcacctcattactttttgcgaaggcagcttatgaaaaagccatctgtcataaaatcttgcggataaatcgttagcatctgatcattgatattcgcagcaatatcagcatttaccgatacatcgattcgttcgaattctggatgatccgctaagaatgcctccactactgcctgattttcttctagcattatagtgcatgtactgtagatcattatacccgaattttttagcgttggggcggcactttctaaaatcgctaactgaatttcgggtaaacgctctagatcagctgcctgcttgttgtatttgatgtctggtttacgacgcatcaatcctagaccggagcaaggagcatccactaagattcgatcaaactgttgttcctcaaaatgttgagcgacttcccttgcatccatcacttccgcttgaaccacctctgagaccgcaagtctttcagcattttcagtgatcaatttaactttatgaggatgaatatccaatgcagtgactttcccacctgcttctgcagatagaaaggacgcgatatgggttgttttacctccaggcgctgcacaagcatccaatacttggtgctctggtgcaatgtgcagtgccggtgctactaacatcgaactttcatcttgtattgtcaataatccgtcatgatataaagaagagccggctaaaaatcctttatcagccacaatcccatacggagatagttggctttctcgagcttcgattccttcttcctgtagttgaaggatggcttcgttgcgagtaattctttgtagatcaaggcgtccactagcatggctaggtactagtaaagacagccctaactcccgggttttatcgctgccgatctgcgctacgaatctttcagttagccataatggcatactgatttctatagctaaccgctccaagggatctttgatttgatcaagtgccggcacaccctctctttgaatcgtacgcaacacgccgttaacaaattttccgatccctggatttccttttgctttcgcgatttccacggcctcatttaaaatagcatgattaggtactttgtccaagtacagcatttggtaaagagaaagacgcaataatgatctgacccatggatcgactttttttgcattcttgataaagttcgctaaataataatccaatagcagctgccgactaatggttccatagaccatttctgtcaataaacgtccatctttatcatttaaacggccttgattcatcagttctctcaataataagttcgaataggcaccgcctctttcgatacgaactaaggcctctaatgcaacaaagcgaacagtatattggatttttcctattttacgcttcatgagtaccaaccttatcacctagttgaatgtgttgcccagtgccatttagaaaagccgcaatggattgacgaccttttccagctggttgtagctcttctaaagctaaaactgtctgttgaccacaagcgatccatagcgcctttttcgttcgttgtatgatggttcctggcgcggcatctgttgtttcatcgactactgctactgaccaaatcttccaacggctcccttggtaagtcgtgaaagcaattggccacggtcgcatccctcggacctgattgtcgatctcctgtgctgtctttgtccaatcaattgcttcttgttcttgcgtaatattgggggagaatgttgcctgctcttcagcttgaggcattggtttcagttctcctgataggatcttaggtaatgttttcagcagtaattctttacccaataaacttaatttctcaaacatagtccccacatcgtcttgattagtgatcggcagtttagcttgagaaaaaatacccccagcatccatttttttaatcatttccatgatggtgacacctgtttccggttcgccttccatgatggcatagtgcactggggcaccaccccgatactttggtaataaggaggcatggacattgatcgctccaaattttggtacttgcaacagcttttccggtaaaaattggccaaaggccgcagtgactaaaatgtctggtgctaattctttgatcgtttccatttcaggtgaaccgctgattttttctggttgcaaaaccaacaattggtgcttcaatgatgcttctttgacaggcgttggcgtgattactcgttttcgacctacgggccgatccggttgggtcactaccgctgcaatttcatagccttctgccagcaatccttctaagattggtacagaaaacgcgggggttcccataaagacaactttagtcattttcgtgttcctccatatattgttctagttcagattctgggatcttatcgatcattttatcaataaataagacaccattcagatgatcaatctcatgctggatagcccgagccaagtagccaaaagcttgaacctccatttcttctccttcacggtcaaagtagcgaaccgtaatctcatctgctcgcttgaccgtaccataggtatgaggaatactcaagcacccttctacatcaacagattctcctgatgactcgatgatttctggattaatcagttcgaaacgatcctcttcatctacttcaacgattgccacttgcaggtttttaccaatctgaggggccgcaatacctacgccgtcatgcgccaccattgtttcatacatgtcttctagtagttgtaccagctcatctgtaatcatagataccggttttggttttcgacgaagctgatcgtcgggatgaataataatcggatagcgcataatatctcctttaaataaaattcaacggttcttggtcaatggaaacgtagagtccttttcgctgatcgatctgactttgttccaataaccgggtcaacagttcaggcaaatgtggttcatttttgtatttaataatcagttggtagtaatagcgatttttgacacgcatgatcgcgctaggtgccggtccaagcaaaatactttgacccgataattctttttgtacttcttggtaaatggcaaacatcttttgggcagctgcctgctcttcgagatgactgcaggtaatttttaccgtgtagtaataagggggatatccgctttgatgccgaacccacatttcttgttggtaaaaagcttcatagttttgggtttgtgctagctgaatcgcatagtgttccggattaaatgtctgaatgattacttcgccggctttctccgcccggccagctcggccgcttacttgcgtcagcaattgaaatgttcgttcactagaacgaaaatctggcagattcaatgctgtgtcagcatttaagacccctaccaatgtaatatccggaaagtctaaccctttggcaatcatttgtgttcctagtaaaatgtctgctttcttttcgccaaataaagtaagtattttttcatgtgctccttttttgcgggtagtatccacatccatccgcaatacccgtgcttctggaaatctagcaattagttcttcttcaactttctgcgtacctgttccatagtaacggatcttatctgcatgacaactaggacagcggtgagggatcttttcttcatgcccgcaataatgacagcgcatcgtcttggtatccatatgaagcgtcaaagaaatatcacagttcggacaaggcagaacatacccgcaatcacgacacataacaaaagaagaatacccgcgtctattcagcagcaaaacgatttgttcttgtttatctaagcgatcttgaattttttcctgtaattggcgagaaaaggtctggtagtttttgttggcaaattcttcccgcatatctactacattgatctgcggcaaacgagcactgagttttgctcgttgattcaaacgcaacaattgataaacgcctttttgcgcccgagcccgtgactcgagagagggagtggcactccccaaaacaacaggacaatgatgatatcctccgcgccatatcgctaaatcacgcgcatgatatcttggtgcctcctcctgcttatagcttgcttcatgttcctcatcgacaataatgacgccaatgttttttaaaggagcaaaaatagctgaacgtgcgccgactactacttgggcttctccccgttcaatttttcgccattcatcatatttttccccttgtgacagtccactgtgaagcacagccacagcgttacctaagcggctcttgaatcgttccaccatttgtggggttaaagcaatctctggcaccagcataatggcagtctttttttgttccaaaagctcagcgatcgtttgaagatagacttctgtcttcccactgccagtgatgccttctaaaagaaaggtttgtgcctcttgtctttttgctgctgacagaatttttgaaaccgcatcggtttgttcttcgttcaatgctaatgctgcagtttggggaaatgatcgatctttgaaggggtcccgatatgtctcaacctcatgaaattcaagccagcctaatgcttgcccttgattcaagacagctgtcgaaatgcctgcttctgcaaaaaatgaaacaggaagctgatcagattcttgtaagactgtcaatagttgttgttgccgtttagcccctttcctgatttgcttcattgcctctggaattgcttctggagagatcaggcgtttcaccatacggattttcttggctttatttttattttttaccacatattgcaattcaacgactgcttcttcacgcaatactttcaattgcgacaataatcccgcttcctcagcagcttgccagctcaggctattcgtctcaggaaaatgcgcttttattgggtgcgtatcatccaataaaagaatattcttctggtattctgctttcatcacactaggcaacatggtctgcaagcaggtaatcttaaaagcaaatgtcgtttttttcatgtaatcagctaactgtaataattcttcattcaccacaggagaaagatccagcaagcgaagaataggtttcaatggttgacctggcggtgtatccgtcaatcctacgataaagccttggatatgccgatccccattaccaaatggcacttcgactcgcatgccagtctctgctacagcgcgcaaatattcaggtatttcatatgtaaaaggttgatctgtctgcatcgttggtacatccacgatcacttctgctgcataggtcatcttctctcctcctccaggctttattttactaaaatgacagacatttgtctgtaaaccttacgaaaatttaacggctatcgactcaaaagaaaaagccagaacacgcattgtgctctagcttttttaattgtctacagattctgttcgtcacgaatccgggcttccagttctttttgctcttggtctttttgcgctttgcgctcttcttgttccattttcaagcgagcacgtttgatttctggatgcggatcattaacaacaagctctgcttcgatttcttccaatgcttgtcctacgcttttcaccgaatcaaattgttccaatgttgcttgggcgcctgcatctagttcatgcgcgcgtttgctggctaaaatcacaagggaatactttgagttcacacgatccaataatgaatcgattgaaggttttaacatcattcgttttacagctcctctaacattttgatatacttgccgattactcgatcaacgcgaaaatgttcacttgatataatttctcgaatccgttgtactgctttagatacttcatcatttacgactgcgtagtcatataaagccatcatttcgatttcttctctggcaacacgcattcgttcatcgatcacttcagcagaatctgtccccctgccagtgatacgtgagcgtagctctgctaaatcaggtggggtaagaaaaataaagaccccatcaggcacttcttctttgacttgtttagctccttgaacttcgatttccaagaaaacatctttcccttggtccaatgttttttgaacataagacaacggggtgccgtagtaattgccaacgtattctgcatattccaacatttcgcctgcttcgatcaaggcttcaaattcctcacgggtgcggaaataataatcaacgccttcgatctcaccttcacgcttgttgcgtgttgtcatcgaaacagaatattgaaaatcgttgtcatcactttcaaaaattgcttttcgcacagtgcccttgcctacaccggaaggtcctgataaaactattagtaatcctcgctctgacataatgacgtcctttcactgacttttgcttaacgtctattttgcactttttttcagcaactttcaagaactactttattataatgggaaattcatgaaattactactcatctctcctacttttagaaccccatgttgcttagcgtattgatcacacctgccaactcatcttttgtcgtgatagctttctccgtaggatcttctacttcctggcaatcaatccgaacgatataccgacgattcaacgataccgcatttccattgaccaaaatttgcaagaactcttgatcaatcgcgacacaagcatcttgccaagcatcaaagtttgctttatctgatgggacgctccgcttgatgacgttttttccgcttaattcatgaaaagtaatatcatagtatttcattgttgatcactcctattcgatattttggacttgttctcttattttttcaataatcgtcttcatctgtactacactattcttgatttcaattgggcttgacttggaacctatggtatttacttctcggttcatttcttgaatcaaaaaatccagctcccggccgatcggcgattttgcctctaacaaagtagtcatagaatctaaatgaatcatcattcgatccaactcttcatgaatatctccccgctccaacaggatggccatctcggtcaacaaacgttcttgatctacttgctcgcctaaatattccgtcagctttttctcaaaacgttggcgatgatcggcttcataaacggcaataaacgtctgtaattccatgattttaccaagtaattgctgctgattttcttttaacacttgataaatcccttgtccttcaatttcacggctttgatcgatagctgttagagcctgagacaaagcatctaacacaccttgctctaactgggtatcttcttgttgtttttctcggatatcaagaaatgcttcatggacgattaatttttccaaaagattttttttcgacagctcttttatatccaacctttgagcagcttcttcttcgacctgcttcaaaaaaggcaccaataaatcccattggactataacttctttatgagccgcattcttttcgttcaatgtcagataaagctccacccgaccacgctgtaatacttttttgacttcttgtcgaattagtgcttccaaatcattcaattgtttgggcatgcgcaactgcaaatccataaatcgctgattgacacttttaatctcaatctctatttgataatcagctgtttctccattcccttttccaaaacctgtcatgcttttcattcatttcttcctttcacatagaaagcagtgcttttttcaattcggtgaattcttcatttgataacgttaagcctttacccattttttcatgtcctggactccagtcacgcaagtcaaacttaggcgggcgaccattccagctgactaaattaagctctttacgccaccctttaggattttccgaaagaacggcgatctcctctacgatctcataagaaaaattatccattgtgttcctctccttttaaaaaataagccagataggctgacagcacagccaattctggataccgcgcacgaatctgctgaaatgccggtgtttcaatttgttgggttcgatagaaaaacaagaaccgtttttgttcagataacaaaaagaactgttcgcgatagtaatacaaccattctgacactgaccatacttctgtttctttcgttggttctgccatgattttctcacgtatcgcttgcaggaaagattcctttgtataaatgacggtcggtgtaagatgtagtaatctgcctatgcattcaaaaaagacgcgcccacaaatttccaaggggacctcttgctgatataacttacgcactttcttccaaaattccttttttttcataaatgcgtacaatcgcggtgcatcttgtcgaagcaaatgaacgaatggcttccacgaatcgttgaagacctcttcatcaaaagtataccaatagccactgaacttgccaaagtatttcatcgtttctaaatacccaagagtcatgttttctagagaacgtttggcatcaaaaatcaaaaaactacctagagtccaaggtgaagcaatttgaatctgcgcaattgattctgagacctgaaccttcttattgattccaggtccttggacatcgacggcaatgacttctgtagcgcctcgctcaatggctacatcaattggcagattgttgcggtaccctccatcaatataatagatcccatcaatcaattgtgcctgcattgctggataaaaagacgctgatgctagcaaccattgcaaactataatcaattttgctggaatcaaactgataaacaacctctttgaaatccggcagacgagtcgtacaaagtaagagctggcttttgctggcattaaatttttctgcatcaaaagtcgctgctaacagctgtgctaatggttttgtactcgcaccattgtctttaagtgctgtctttacgagtgagcgtaattgctccatcatatctaataaggtttcttttttagcagcagcttttgggtattggaggacctgttcactagaaatattcgtccataattgctcagcagcttcaatatcgtccattaaaaccaatgcaccattcaatgcaccaactgacgtccccgctacccactcaaatatgattccatgttttttcagcgcttgccatacgccaatttgataggcgccatgggcgcctcctccacctaggacgaaagctgtatggtagtccagttgcttgtggtacccctgtgtcaccctaccatatccacgtcccacaaaccactgatccatgatggggtttcttgtcatttcccaaagtatctggtctacgaaacggcttctagcaaaactctcagtcatcgaaacaagtgtctcccaagtaaatgcatcacttggcacctgcaacaaattctgaatggtcagaagcggcccttcatggacacaagacagatagactgtgccgtgttgattcgtcaatcgccacccctgttcgttgaccactgattgaaaagcggctcgcgcctccgaatgactagaaaaaaaagggaaaactagtcggctttgttgaaacacatcttgggatacatataaatcagaaaaataaatttttgttgtcttcatccgactcctcctcaaatgcaaaaaagaaaccacggatgatcaatgaaaatttctgacatcattcgtggtattcttatcatttaaaaagtccgctgttccatattgaatgcggcccgcatctcgtctgtcgcatcagcaactggtgtaaccgattcaagatcaccctgaaccacacgtctggttactccacccatttcaccacatgtaattaatgtgatcatttttctccctgctacttcatccaataaataaacatctgttggttgaacccgcacggttgaagttgctgtatatgtataaatattttctaaatccgtaatataaattgttgcgccaatagccacatcatctaaaggtgtgaacaaaaggtctggcgactgcgcacgatggctagctagtgcataatttccttcgcccattttttgtgttgggctaagagttcctgctccatatagcaaagcttcattcgataaccccttaaaaatcggcaaattaatcgctacgctaggtatcgcaacaccaccgatcactggtaatgtgctgttacttagttgcgctttaagaactgcttctgagctggccggttcaacggcatcaaaatcaaaagtagtatctgcctccatattttttttgacatcggctctagagatctcggaaactgcgtaagcatctccgttgtgtttgatcagaaaatttttgatttgattattaaaaatcaaagcaagaccaatcaataacaaaaggaccaaaaatagattcgagagccaatggaacaaagttcgtttctttttcatcgtttttcgtctccaatttttattactcctatcataacaaaatcattgcagaagcgccaattttggattttttttaataaaaaagcaaagttttttgcttcataaaaaaacgtaatcttaaaaattgttttttccgttattttgtaatataactttaaacgaaaagatacaagcaatttgatacactttattgtagaatgaacttattatcagggagggattaattggcatgtcgaacacgatttatgtacatattgatacaaccagcaatgccgtttcgactcgcggagtggatgctcaagatttcaacaagagcatcgttcaccagccaaaaaatctgttgttgcttgatccctctagtgaatttggtgaatttgagtcgcatacagggctaaagattatccgaggcattgaagatgtccaccttttctttcaacaactcaaccgcggacggatcacagaagaaatcaaatggatcgactttaatgatttagaaatggtaaaggagctaacaccgctagaaatttcagaattgttatattttgggcatatgaaaacgcatcttcattctccgtttttctacaaactgcaaaacaactttgtttatttcgacctcaaagatcagcgttcccgtgtttactaccgctacctggaagaatattaccgaattttagctgacaaaatcacgcacatcgttctagaaaaaataaatgatcgactttctttcttcaaaaagcctactccggtctctaaacttgatttaaatcttctcaaagacttgcggggggtcatgcaggaaggaatcatcttatgtttccatcaagaacaattggtcgataaaacctacacaatcccgatttacttagtcgaggaatctgggctcaaaaatagtcacctctctctgaaagaagactatcaagtggcaacgcttcgctactttgcaaataaaaaagaatggcagttggaattggatcaagatgatctagcttttggttttatcgataaaaaatgacttgctctcctattttgattttggagaacaagtctttttttacgcagtccgatttaaataatcgtccttaggtacaaatacctctggggatgttcgataagcaattagtaagataattgccgtgacgattgccgtagcaagtccgctggcggtattcattaccagagagaaaagccaaggtttcatcccccagagagcatatgcgccccagtaaacccaaccggcaaggaaatgccaaaaataacgagcaaatgcgcctgtgaatgttgcttgtacaagtagtcgttgcacgctacccttcgaaccatttctaatcgccaaatgaattttatttgcataaagtccggcaaaaccaacaaatgtaaaagcaaatgggtactcaatcaatacttgaagaacactcaaaaaccagactttacctaatgggaaatgcagcaatccccaaaccaatccggccattaatcctggcttccagcctctacggatagcaaatattgttaatggaatctgtcctaaagaaattgaaaaactacttccaaagtctaaaggaatcagcgatagtaccatcgccagtgccgccataatcgttccctctatccaaatttttgtaccatttcccacaaaaaaactcctcctttagaatcatcacaattcacaaaggagaagtgttagacacttcaactcgtcacaattcctacgttcgcatgatcgaaacaggtacgaagggtttagagtactctcattctcagccttttcagactcccctttgtgattagattctattttattttgcttgcactgctgcaagtcatcttcaagaataccacaaaataaaaaaaagaaaagaaaactcgctctgataaaaaaagaaacatctcaaccgcgtctagacgagatgcttcttttgggttatcatttttaaatcgataattttgattcgaacagtggactaacaggtttattctcatggattcgtttgattgcttctcccatcaatgcactaacactgatttcgtcaattttttcagatttacgatcttctggcaagaaaattgaatcagtaactactaagtgctcgatagctgaatcttcgatccgttgcaaagcaggtcctgataaaacaggatgagtacatgaagcataaacactttttgcaccagcttgttttaatgcgttcgctgctagagtaattgttccggccgtatcgatcatgtcgtcgatcaagacacacgttttgccttctacgtgaccaatgatattcattacttcagcaacatttgcttttggacgtcgtttatcaatgatcgcaattggtgatttcaagaattctgctaatttacgcgcacgagtcactccgccgtggtctggtgaaacgactacaacgtcatctccttgaatatctctttccaagaaataattagcaatcaatggtgcacccatcaagtgatctacaggaatatcaaaaaaaccttggatttgtgaagcatgtagatctaaggtaaccatacgatttgcgccagctttttcgatcatgttcgccaccaatttagcagtgattggttcgcgggaacgagctttacggtcttgtctcgcataaccatagtaaggcatcactacattgattgttttcgcacttgcacgtttcaaggcatcaatcatgatcagtagctccattaggttatcgtttactggactgcttgtggattgaataacatagacatgtgaaccacggatactttcttcaatgttaacttgaatctcgccatcgctaaattggttcactgaacacttacctaattccacacctactgcagctgcgattttttcagctaacggacgattagaattcagcgaaaaaatcttcaatcttggatcaaaataatgatttgacatgagaacctccactttctttgcgttcatctggcaaaaagactactagttcaccagaatcttcttcctagtaaatagtagtcatttttgctaaataaatcaagtcatttcgcagtttcttcattcaaataaggcaatttttttgcatagccttctttgttttcctgccttgctcgggcaatcgccatgctatgtttaggaatatcttttgtgattgtagagccagcagcgatcatggtttcttcctcaatctgcaatggcgccactaaattcgaaccagagccgataaaacaattgtctccgacaactgtcttgaatttatttttgccatcataatttacaaagacgacgccgcaaccaacattgatatttttccctagcgttgcatctccgacataagagagatgccctacttttgttccctcaccgatcgttgcattttttatttctacgaaattaccaatatgggctctttctttaatgtctgcttttggacgcagatgtgcatttggtccgacatctgccccattgtagattcgactttcttccaccacagatgccttgatcgttacatcatcaccgatttgactgtctatgatttgagaagatgcagtgatgacacagtcttcaccaattttcgttgcacctttgatgacgacaccagcttcaatcagtgtgtctgctccaatttccacgccatcatcaatataagtagtatcagggtcaatcaatgtcacaccattgcgcatatgctgctgattgatacgcttgcgcatcaaacgattcgcttctgccagcgctaatcgatcattgactcctaacgactcattgaaatcatccgtttgataagcagctacaatcttcccttctgctttcaagatctcaataatatctgttagataatattccccttgtgcattatcggtatctaattttgccaatgcatcaaataataattcattgtcaaaacaatacgttcccgtattgatttcttggatcatcgcctcttccacagaggcatctttttgttccacgattttttctacgacacccatttgattgcgtacaatccgaccatatccggtcggatcttcagcttgcgcagttaaaatcgttgctgaggctttttgttcctgatggaactcaaaaagattattcaatgtctcagtcgttaacaaaggggtgtctccactgattactaacgttgttccccgtttttctcttaagaaaggctctgcttgaacaactgcatggccagttcctaactgttctgcttgtaaagcatactcactgcggtcccctaattgttgcttgaccatttctgctccatgtccgacgattgttacgattgcatcaggttctgtctccactacgcgattcatgatatgttctaccataggttttccgcaaacgggatgcaaaaccttgtataacttggatttcattctagtacctttgcctgcggcaagtataattgcaaaacgtgattccacgtgttccactcctatcgattccgactgattgatttctgtatatgtccagtttagcccaactaaggatggttttcaatatataaggaaaaacacaactagaccaattaaaaaagactgattcaaaatcagtcttttgtttcaaaataattccccggcacgaccgagatcgttttcgtctgagtatcaacgtcttcaacaaacagcagcgaactataatcagaaatagcacgttttcctttgaatttagcttccgcaaaaaccgttatgccaacaagttcagcttcaaattcttcgatcaagctcttcataccgttcacagtgccgccgcctttcataaagtcatctacgactaagactttggaaccgcgttttaagctacgctttgataattccattttctcgattcgttcagatgacccagaaacatagttcacgctgactgttgacccttccgtaattttagaatctcgccgaacgatcacaaagggaacatttaaataataagataccgcttgtgcgattggcactcctttagtagcaacagtcatgactgcatcaatttgtttatccagatacttcgaagcaatgatacggcctacttgccgcagtagctcaggttctccaagcaaatccgagagataaacgtaaccaccaggcagcagtcgatcttgctcagaaaggcgttccgctaacccttcaacataggcataggcttcttcttttgaaatctcaggcacaaaaaaaacaccgccagctgcacctggaattgtatcgagagttcccgtaccacgttctttgaaggtctttttgataatcgctagatcttcactgatcgatgatttagcagaagcatagcgttttgaaaaaaatgacaatgaaatcaattcatgcggatgattcaataaataatgtgtcatatctatcaatcgttcacttcgacgaattttcacacatgcccactcctttaatttattcgtcttattataaggctttttgcgtataaatgcgagcattatcttgaaaatctaaagaattgttcgcttttcattcaatcaaagaaaaaaagaaacgaaaaattttcgtttcttatcgttttaaccgttgttttcgttggaaaagaatgacaatacgcttgaccacattgatgactaaaaacaaaccgataaatactaatgtgatcgtagcgcctggaggtgtatcgagataaaaagagctagtcaatcccgacagcataccgaatagaccaatcaagacactgatcaaaatcaccgcattaaaactcttgcctaaacgcatactgattgcagctggcaataccataatcgcagaaatcagtaacgcaccagcgatgggaatcatcatagcgatagcaatccctgtcaaaacattaaaaagcatcgacattatccgcactggcaaacggtctacatgagccgtatcctcgtcaaaagtcaggacatacatcggacgtttgaatagaaagaagagaacgaatacagctaaaaataaaaagcctagaaaccaaacttgatcctgagtaatggtcacgatggaaccaaagagataggattggatactggtcgctgagtttcctccactcagattcataaggaccaatgctaatgccaaaccgcctgacatcaaaatcgcaattgagatctctgaataactccgataaagtgttcgtaaatattccaaaatgaccgcggcgatgattacgattaataaggtcgtgagatctggattcaaattaagaaaaaagcctaatgctacaccagctaatgaaacatgtgagagtgtatcggccatcaaagactgtcttcggatcacaagaaacacacctagcatcggtgcgattccggcaataaaaattgcagccaaaaaagcacgcctcatgaattcatatgaaagcaacgccatggtgaatcctcctttcgaaccaaccgaatttgtcgatccgcatactccttaatatcttcgtgatcgtgggtgatcatcaaaatcgatttcccatgatcgtgtgcattgtgacgcagtaattcataaaataaatttcgtgattgctcatccatccctgtcgttggttcatccaaaataaataaatctggatcagtcgcaaagatacgtgctaaactgattcgctgtttttgccctccggacagttcgccaatccgttttttgcgcatttcccacatacctactgcatccaatgctcgccgaacatgttcatgatcccgctttgtcagcttcttaaaccatcggtctttcggataacggccagattggaccaattctaagactgtacttggaaagcctacattgaacgaggcaatctgttgtggaatatagcctacacttagcttttgtccttctctgtttttggtagccagtattacttctccctttgatggtttcaacaaccctaatgttgctttaatcaaggtagattttgcagccccattttctcctgttagaatgacgaattccccatcttcaacaaaataagagatatcctctaatacaggctcatcatcataataaaacgttagtccttttacatcgatataacgcacagatgtgcctccttacttgatacttttttgtaaagcttgcagattttccttcattactgtgagatatgtttctccatcactaatctgtttttccgtcaaactttctaacggattcaatacagccaattcaaccccagtctcattcgctaaagtttccgcgactttagaagaagcattttcttcaaaatagataactttgacttgatgatcctcaacatattcttttagctctgctaaccgactaggagttggttcttgatctggagataatccagcaatcgattcttggactagatcatattgttttgccaaatatccaaaagcggcatgttgtgtgacaaatgttcgattgaccgcatctttcaaagcagcagtgtactcttgatccaatgcgttcaattgctcaatataagcagcggcattctttttaaatgtagctgctttcgttggaaatttctcgcttaactgatctcgaatcgtttcaacttctttgattgccattactggatctgtccacacatgcggatctaattcatgggtatgggcgtctgtcccatgttctgcttctgcttccgtttctccatggtcttcattttcagctaaatcaatctctttggccgcttcgatcacaactgttttgtcagtatcgatcgaatctgtcattgttggcacccatgtttccaattccggactattgtacacaaaagcatctgcatccataatttttgccatatctttcgcactaggttcataatcatggggttctgtgcccgccggtataagcaaagatactttacctgtatctccaacaacctctttggtaaactcatacattggataaaaagtcgtaataacctgcaaatcctgactttcttctgcgacttgttctgatccttttccgcaagcccctaataaaacagtactggtaagcaaaaatagagctagtaattttttcatgatgattcctcttttcttattaaaacggaactaatccgatttatcagcaaaaattactctaccaaaggaaacctcattcgtcaagacaaatcgtatgttttccgatttagggcgttcctctgccagtaaatcggaaaacatgggaaaattgattcatatatccgctaagcaaaaaacagatgtcacattttttgaatgtgtgcatctgctttttaatttgtccttttgtttcctactattttaatgtgcgaactagataaacctcttcacaaaaaccttttaaagcattatacactcgctgagcccgtgagtatttctggcacaaggcaaaaacagtcggtccacttccagtcatcagtgccacatccgcaccatatttcatcattcgttccttgatttgttgtacgactggatgcttaggaatcgtgatcgattccaaactatttcccattgcagcaatcattcgttgataatcttcagcaagaattgcatcagaaagttcttgaatatctggatgatgcaactgatctagatcaacttcttgaaaaattttacctgttgaaacacttagtcggggcttgactaagaccacccagcactgcggcatcgggcgcaacggcgtgactttctctcctttaccagagatgaacgcagtcgttccataaatgcaataagggacatcagtacctacttccattcctatatcgatcaattccggcatcgtcagacctaattgccataagcggtccatcccccttagcgctgctgcacaatctgtactgccaccgccaaggcctgctgctacagggatatttttcgtgatccgaatcaagatacctttattgataccatagcgttttttgacaatactggctgcttgatatacattattgcgtttatcgatcggcaagaaggccttattggtttcgataatgattttatcttcttctagctcttccattatcagacggtcggctagatcaacactggacatcaccatttccaattcatggtaaccgtctgctcgcttacccaaaacatcaagtcctagatttatcttagcaggcgctttttcaataatttccatcttattcacccaatcatctgatagttaactagttctatcatagcagattctttagagatagttgagatatttctcctgtttttgatctttatcagcttttgggttgctctttgaaatcgttcctcgtaaaataagagtaacaaatttgatcaagaaggcaggggaaattatggcaaatctaattcctagagatctacctggtggagaagaactattaggcaaattgatgaacagtttctggcaagaacgacaaatgaatacagatattaaagaatatgaagatcattatgtagtcaaagctgatcttcctggtataaaaaaagaaaatatccgtgttagtttcgtgaatgatactctaacaatttctgcttcccaaattgaagaaagcgaagagaaagatgatcttggtcactacttgcgtaaagaacgatctagcagtgcttatcaacgtgcattcactatacctgacattgatgaagaagcgatcaaagcacggttcgaagatggtgtcctttccttgaatttaccaaaggcaagttacaaagacgcgccaggtaagcatattccaatcgaataattgaattatcgcaaaaagtaaaaaagacttcagaaatatcagtttctgaagtcttttttgttgtatttctaccttgccttaccagtttgacgataagcttgtcgagttgttgctgtgggtatttcttcttttttgacataaagcttcaaactataaggttcatgatattttacatcatttttgacaaaatctccgccagtaatgaacaacccaactggttccaaagctttttccccgttccaataaatacggccaattgttgttaagtcactatagctcgtaccaatttgcaacgagtattcagaatctgaccgttgtttgacaaagtagtagggataaagggtatttttaggaatcacaaatccttgtgcgatagcattcgttgctaattcatcttttgaaatgagtttctgtaaatagtcagccaataccagttgatagtcttcttcaaaatcaataactgctttctctgttgataaacgatcgatttgtgtggtgctaattttttctccttcaatattgaatacttcatcaggtaaatacttcacaaaaagctgagtaatatctaccttaagatttttatcaaaaaagtaataaaaaatatttagaacccagaaatagagcaacacgcagaatcctatcccgtataaagccatctgtaaataattttgattgagatagagaccataaacaatacgcagaatataagccgttggaatcaaactaagtaatgtataggcccgattcaagtatttaggactaatatccagataacctaagaacttatgaatcccattgatcatatctaataaaaaagtcatttattcacctactcattttcttgatcctcattgatgactgcttcttggtcagccgcattctgatcctgacttgacggcgtcgtttcctcgctttgcccgttctctgaagaagggacatctgtagctggtggtgtagagctatcctctatcgaagatgaaggaacagttcgctgattatttgttgtggaagatgtagtgcctccatgatcttcagctgatgttgaaggttctgtgctttcagacacaggttgactgtctaccgattgcgagtgactaacatcgctggtttcggtcgtttcagtaatctcagtcgagtgactagttccatttgactgccgatagctactggaattcacaacaccagttgcagtagcgatgatggttgaaatggtcaagagagcaattggtttcaaaataggaggtacttttcgcataattttccatccttgtcttgattcttatcttttttgcactcattgagtacttactttctttatagttctttccttggaaatggtcaagactacgaaggattaacggaacagatttaaaaaaaagtaaaaatgttttcggttacaaacaaaaactagcttctgctaggctctaaataagaaattcgtaaaacttttgtacagaacgagttaacgcagagtgataatccactatcagctcttttaataagatcgattcttgtagctcaaatggctcagtcaattctaaagtgatccgagcaccgtcgatgaaataagcataggacagttcatcatcagacaattcggctagttgattgctccactcttcgaagaatttctccgcgagcacatctccaacttcctcaagaacaggttggagagtctcttctacttgataaaaaggtcgtgacaaaatagatgccgttgtctttgagtgggttgtattttgaaaatccaaataaagcaagtcaatgtagtcttcttcttcacctgtttcttccagccatagaatgccttgcttgaccaatgagacacatgtagattctacttcctttgataattctatagtagcatctttgaacctcagattcttttcgactatttgctcttcacccataaattgcaagacagctttttcaaaaacgagcggctcatctgtaataaataattgaattgttgccatttttttctctctttcttttttatctaatttatttttgctctaaacagattatttgtcagcggtatgaatcttcgttagcatagaaattgaagatgaataaaagctaatttttaaggaggagatttgatgagtaaaattgccactatcattaccgatctagttgaagatattgaagtaacctcaccaaaagaagcactggaaaatgctggacatgaagttgtcattatcagtaatgaaggcgtggacactgtcacaggaaaaaaaggaaccacttttgcagttgacgcgtctattgatacaatcaatttttccgattttgatgctttgttgattcctggtggcttttctccagaccaattacgtacagatgaacgctatgtcactttgaccaaagagtttctgacatctgaaaaaccagtttttgctatctgtcatggacctcaactctttattcaaaccggattgacaaaagaattaacattgactggctatgattccattcgtccagatttaacatatgcaggtgctactgtcaaagatgagcctgtggtgattgacgacacgcatcatttgatcactagtcgtaatcctgatgatttggatgcatttaatcaagccattacaacagcacttgaaggcaacaaataaagcctaaattttaaacgaagaactcacaaatagggtgtacgaatatcgtactccctatttttctatcctttagcgattttacctgctgtttttgttcgcaagttcttttaattaatatttctattcatccatagaaatgtcaaaaccatcaaatgtctcaccatcataatatttaagtaattcatcgagtgatagcaaagaagaagtcatctcctcttcttccgtttgttggtgtttttcccaatagatctgataggcttccgccaattgtcgatagacatctttccgtgaaccaccttctgcctgcagcattggcaattctcgaataaacgcactataacaaggacgaccatcttgccaactgataggtaattcaatcacatgtagttgggcttcttcaaaccatctctccatcccgatccctcatttctccctttattatcacgtgaatgattcagaaggtcaaacttcctgtcaaaatagactaaaaaacactggctaccgatggcttatccatgatttggaatagcaatcggcagccaatgatcatgcagctacataagcatatttttcaatgttttgtttgatcttctcaatgattctctgatcctctacacctgtgacttctgtgatcacttgagaaagattagctgcttccaataactctctcaattgttgactttgctcgtcctcaggatcatgatagttgaaaatcataccaatcgtttcatagagatggaacggttgcacatttctcatttgcaattcaaggacggggcggataaatcgttcttgtgcgcttaattttcgcaaaggggtgcgggctactcgagcaatagcatccgaaatgtagttatttttgaatcgttgaataattttttcaatatactgttcatgttcatcaggatcaaaatcccatttggcgactaaaagttgaccagtttcttctagaacggatttcagctgaatcacaactagatggtcacgcatggcttcatcgatggtctcatagccttgtagagctcctgtataagctactgtagcatgacctgtgttcacactaaacaatttacgctcgatataaggtttcagatctggtacgtattgtacgccttgtagacgaagcactgatttcattgctgtttcttgaactacccactcacaaaatggttctacttgaaccaacaaaggatcatcatgttgttgcatcggaacaatgcgatccactgctgcatctggaaaaccaacactattctccaggtaagcgagttgttggctatacttttctacttcctcttttagaaaagtggatccaccgatcatattttcgcaagcgatgacatcaattgcttgctcctttttcttgattgctcgctgatccagcccttttgcaatgagcggtgcaatgcgaggcaatactgcaggaccaatggcagtggttaaaatatcggcttcgacaattgcttgaacaaccgcatccggttcttttgcgttattgattcctgtcacgtgttcaataaaaatctgttcgcggttctcatctgctaattcaattgtataggatttacgttgctgaagcgcagcaataatcgtttcatttacatcaacaaaggttatttcaaaaccgtttgctgccaaaatctctccgataaaccctcgaccaatattccctgcaccaaaatgaactgctctcatctttttcccctcctatgccactgttagattagcggcgacttcttctttgctcaaagcatccgctaattcgaccacattatcgatatcgctacagaagagagcgatttgttgtaccaactgcaaatgatcttcacctattccagcaatgccaaataataccgtaacgattttttcatcctcatctgtcccgaaatttacgccttcaggcacttgaacaatgcagataccagattttttgacatatttttttgcttcatctgtcccgtgtggtatagctatgaaattccccatgtagacagataacattgcatctcgttcgatcatagcgttgacgtattccggatcaacatatccggcctcaacaagttttttcccacaataacgaatcgcttcttctttgttcgcaaactgttgattcagctcaatcatttctttttctaatagtttcatttttcttcctccttaaagagcttctttaagtgttgtgattacacgctggtagtttgacgttcgcatcaaattgctgacagatagatggactgcatctggtgctagcgaccgcgcttgctttgtcagctcttctttggtaattaccaatgatgaagcatccgcttttagattatcgatatgaacctttttaagtgataaagagagagattctttcgctaataagtcttgaaaaacctttctcgccatggtcgctgagccttcacgatcgtcatgggcaagaataacttcatgaatgccctttaattcctctagaggcagtggcttataatttactgctttcgtttttttctcttcctcaactcctgagcctgacaatgtggccacgatctcattatatttaggagaattcaaaaaattttctacagcaacaaatgttgcatttggtgcttttaattttgcccgctcttgtaactctttttgtgtcacaatcaatgtatgcgcatcatctgtcagattattgattgcttgattagtgacttgttgagccaaaccagcatctttaactttcttacgcaaaatggaagcccccattgcacttgaacccataccagcatcgcaggcaaaaataatcttctgaatgcctgttaacgattctagagccactccttttgaacgctgttttgcttggtgtatttcctgtaccttctcatcaaaattatctacagtgtctttggcatcggcttttagaattgctgccgccacaagaaacgatatggttgctccaacagcaatccctgctaaaacagagacgacactcatcaccgaattcaacggtgtcatcgctaaaatagcaataatcgaacctggagaagctggtgcccttaaacctgcacctaataattgaaaagtgaaactcccagaaacacctcctgcaataacagctaaaaacattaatggcttcatcatcacatatgggaaatagatttcatgaataccacctataaagtggataatgattgctcctggagcagatgattttgccgcgcctttgccaaagaaagtgaatgctaataaaacacctaatccaggccctgggtttgcctctaataaatatagaattgatttaccaaactcgcttacttgttccgtacctaatggagtcagaattccgtgattgatggcattattcaaaaataggattttggcaggttcaataaaaatatttgctaatggaatcagatgtgcattgacaatcactgcaacgcctgctgccattacttctgtcaatgtgtttacaacaggtccaatgacaacaaagcctaacagagccaaagcaaaacctagaagacccgcagaaaaattattgactagcatctcaaagcctgcccgcactttatcttgaaaaaattcatcgaacttcttaatcgtatatccgcctaatggccccataatcattgcacctaaaagcattgggatgtctgttcccacaatgacccccattgtagcgattgccccaacaactgcgccccgatctccagcaattactttcccgcccgtgtatccaatcagtatcggtattagataagtcagcatcggaccgaccattgaagcaaaggattcatttggcagatagccatctggaataaagagagccgttaacacgccccatgcaatcaatgcgccaatattgggcattaccatactcgacaatgtactacctagtttttggaccctcgactttaaagacgcattcctgtctgcttgtacttgttccatcttcattctcctcccaacttgtttttacaccttgattgtaggcgctttccgaaagcttcgaaagtcgtactttgtcacaggaaactgtgccaaaatttgtctcttatctacaaaaaaaagccatgcataatgcatgactaatcaataaatgcccttttctactcttctagcgatagtattttttggatttcctctattgtagcggcgtcgcttaatagttttacattttggatatctgaacaaaaaaaagcaatttcttgcaagcatgacaactgcttttctttgagaacaaccacaaacagaatcgtagtaacctttgattcttttgcatcgccaaaatcgacaccgtctggtacttgaacaagacaaatcccttcttcattaatccatttgtctgcctcttcttctccgtgaggcaaggctacaaagtttcctatataaacaccatattttttgtgtcgctgaattaaactgtttatatactgaggttgaaccattttttggtctactaagaatgtacctatctcatgcaatgcttcttctgcactttggaatcgctgatctaacaaaatatgtgttgctggaatatccactattttctcctccccattattgtttgatttcttcaatcaaaagcgtagcaagcaattgataaatgatggaaaaatttcctgaattaaatatttctgtattgagatcattcataatgatggaaccgctaatcctccctaagattttactgctttgctcatcgattggataaggagcgagcataactaacaagcgagttacgttaatctcttgtttatccatcgcataaagtgatagtccttgtgataaatcaaagattttgaaaactggttgcaaaatttctgtacttgacgcatgaaaaagggcaaagtgagtcttcggtattccaacaggggcttgtaaatagcgcttcactaatttattggctactttttttctgtcttgcactaacgctttggaaaaatgtttcatcacttcagataatgtttcttctaagttggggccattgtcaatcgtttgaagagtaaacaattctaataagcggttaatctcctcaataaatgctagaacatcttcataggtatcttccctagtagaaactggcgtaggtattgcatgagaaagtctctttttctgactaagcagacgaaattcttcttttagttcctgaatgtcttcttccaataaaataggagatactagcttatattttcctcgataacctggcaacaaagatgtggaaatcaccaagtcgtagttgccctcaattttatcctgttcgatatcccccacacggaaaaaagtaattttattgataaatggaaattgctttcttagctgcatctctaacaaactaattgaagccagtccgcttggtgatacacctgcaatattgacttccatcactttaggattcttttctaatgagtttgcgaagtgcaataccatataggcaatttcttctgttgaaaactgctgttgtgggaaaacaagcggtaagcttaaacggattgcttctgcaatttcctcatattgtttcattattttttctaaaattggattgtttagatggttctcttccaaaatcgctcgggtcattaccccagaaatatgtgttagcaacattttatataaaatttcatcttcaaaaaaatcaacctcagtgtgctggctaatcagttcgatcaaccgttttacctgatatgccaaagttgtatcaaaattctcttcaaaaaaatcgcggtcaaaagaattagaaaaatcccctaataaaatcgcaaaaaaaactatttcattaaccgaatacaaccgcttcgtttgttcagcaacttgagcaaaaatctgtttagctacctttagcaaatctttgttgatttgacttggataactttcttcctctactgagaatcctgttgctactcgctccatggctaaagcaagcataataccaataaaagccaacttgcgatcacttaactcaggatatttagattcaaccacttctcttataagatcttgcgctaaaatcaagtactgtttttcaataaactcaaataaaaaatgcgccgtttgttctgcttcaggaaaatgaaaaaactggtattcatttatttccatcatcaacgtattcgctgctactaaacgtcgatgtttttctggtcctttgagctcatatccttgattacggacaattgtcaacggaaggcgcgccaaactttcttctaattgtttaatatcagaaaaaaaagtagtattactgatttgatagagctctaaaaaacgatggctactaatcggcttagcagtagttgctaattgcagcaaaatcctatgttgtcgctctattgacgcaaactcttgggatggatcagacataattgcttcttgcagctgagtgatactattcccgacaatgactcgaaaatgtccacgaccttctttttctaaggatgcccctacagtacgcaacgaattctctaaattggctaattcgcggtagacagtccgcttacttactttcaaaagctgcatcattcggtccatagaaacaggaccgttactgttcattagctcagtcaacaaaatagtttcacgcttagtcaagaacataggcgactccttctgtcatcaattgacgatatttggaagttgtcactaaatcatcgacaactaagtgggtgacatttgttaatgcagccatttgctgaaaatctttttgaacgatatataatgcctctggattaaactgggttgtctcaatatcttctttctttacctcaataggtatggctaattcattggcaattttacgaacgattgcaacagccatcgtttgagcgcctcttttcttgccttcatacaaaaaaatcaatgttgggattttttccccaactttaaaagaaacatttgctaccgtttcttgctcttgctttaaaagtttaactagtgttttatactctgattccgctaaaaagttactcaagaagtaatgttgtgcttgaggtgtctttgtttgagctaaagcaccaagccctgattgggtaataactaaaagatcttctccatccttcaactgataaattgaattataatcgacaggtatggaaatggctgcttcttctaaatgtttagttaataaacttgccccaattgcgctagatcccatccccgcgtcgcatgcaacgataattctctttactttatccatacatattgttccttccgtacttttttcattcactgagtgataggtcaaaacaaaataggcaacaaaaaaagaaacaagcgtgcttaccaatactccagctaatacgcctgaccacatgtgatttggcgtatttgttaagatagccaaaatagaacctggtgaagccggtgatcgtaagccaactttactcaattgaaaaataaatgtaccagtagctccacctaaaatcggtgcgataatcaataatgggttcattaaaataaatgggaaataaacttcatgaatacctcctattgcttgcacaaatgcagcagcagtcgccccatttcttgcttttttagaaccatacctcatacatgcaaacaagacgcctaaaccaggaccaggattggcttcaagcagaaataaaatcgacgttccatgaatactggcgccttcaacacccaacggcgtaaatagaccatgattgataatattattaaaaaaaagaacctttagtggctccagaaaaagatgaatagcaggaaataaattctgcttgagaaaaaaatcaactaaatgataactttgttgactaagctgatcgagcaaagggccaaatacaaaaaagttacataaaaatagaagacctccaattaagcctgcagaaaaattacgaaagagcatctcatagccagtctttacttttcgagaaaagatatgatcaaagaatcgaagcataccacccgttagcggaccgataatcattgctccaaaaacttgtggaaattgagaggttaaaatcatccctaaaattgcaattgctcctgaaactccacctcttattggttcaaccatttttccgccagtgtaagcaagcaatattggtaagagaaaatgtaaaatagcttcttctgacttgatcaaccccccctgatccgcatgtagtacgggtacggcaaacgcaatgactgcccatgcaataaaaatacttacatttggcatcatcatatcagaaaaataatgagtatagagttttaaaaattgaattgtttgtcctctgtcttttattcccttcatcctcctcacctacctaacactagtataatttggttttctctaaaaaggaataaccatagattatgcttcctccttttgaatgtaccaaaaaagctgacgaaaaacgtcagctcaagttattgccttatttttaccattttttatttaattaacacgcacagcaaaacttggtgcgtaataagagtagctgctaactgaaacgctttgtccaatggtaggtgcatgaatgtattgtcccccaccaagtgcaatagccacgtggtgcgtacttccgcgcgatccccaaaataataggtcaccagcttttgcttcattgattgagataaccgtgccagaatactcttgatcataggtcacacgaggtaatgaaattcctacttttgcaaacacatattgagtaaaaccagaacaatcgaatccgttcggtgtcgttccgccccagacatatggtgtaccaagatatttcattgcttctgaaacaattgctgacccgtttacagattgtgaaggaacgtttgtattgttttctggtttattttcaggcttatttacaattgtttcttgttttggtgtatcattttctactgagtcacttgttccggtactgttagtactggaagattcatttgttgagcttgattcatttgagcttgactcatacgacgaagttgattcgcctgtttttgttgtactacttgtgcttgattcggcttgcgcagcttcttcacgttctcgagctgcttttgccgcttcttttgcggcagcaattcgtgcctgttcagcctgatagctttccttttgtttttctaggtcggctttttcatcttctttagatgattgttgcaaagcaagatctgcttgcaaaacattcaagtctgcttgcttcgattgaagtgctcctacttgtttctcaagttcaagttgatttgcttcaatttcttttagttttttatcattttcattttttttcgttttaaccgtttcttgatccgctttttgttgttgaaccaattcgttattagcactaacaatcgtcgtcatagcttgaacgcgaccgatagcatccgttaaagaatctgcttcaagaacggcatcgataaaattggtgctttgtccattcacttggacatctcttgcttgttcttgaatcgctttttcccgtttttcaatacgaacattcaagtcgtcgatttctttttgtaatttttctgaatcagcatgtaaagtagattgttgcgtcaataatgcttcagctttttcattgatagctgcaacatcattttccaatgctttgatttgtgcttgagcatcagcttgttgattttttaggttactgatttcttgatctttttgttcgattttgctatcaaagtcgtctgccgcgacaagtgttggtgctacaactgaagtaagcgcaatggaactcactaatattactgatagaatacgttttttcacccttcattcctccgcctgacttttcattgaaagtttaagttaattttaaaatatataagaatatctaaagtctttttacgataaagcgattgtaacatagatacatgtcaagcagataaaaagaatgttacaaacagatttcaaataatctaccagattcgatacaaaacataacaaaaaaatgaagctattcttctttgaatagcttcatgaatggaataactaaaataacaaataaaataatatttaatagcagtgtcggtgctaagaaacgagagacaaaaaatgaagtattgactgttgctattttaaataacaactgtatccccaaagttaccatttcaagacccgtaacgaaaataatcattccaaaaaacatggtgaatatgttttggtatagcgttttatttaaaatatacatgatccacacaatcatcgggaatgcgacagcataaataccaattatgccaatatagtaaagatcatacaagcatccaatgatcaatgcggttataatcaagtagtttttaggcaaatatctggcactacataggaaggcaatcaatagtaaatgtgcactcgctatataattatcttgcgtccagcgctcaagtaaacgggttaattgtccatctaacaacatcatcaagaaaaaaaatgctccggcaaagtactttaaatacgtattttttttcatgcctatttgtcacccgccaaacgtttgataatagtaactgcttgaatatcatacatttgtgcataaggttttacatatacttttgtatctaatccaaattcatctttggtggtactaacaactgtcccaacagcaaggtcggctggagaattccctcctaatcccgaggtttgtacaacatcgccttctttcaattgtgtacttccagtcaattgactgataaccaaggacttctctttttgatcataactacttagaattccaaaagtttcgccgtctttcccgctgattcgaacaggaaaatgatttgaattttgattttcagaagtcaacaattcgatttttgaagatgctgcattcacttcaatcacacgcccaatcaaacctttttgggacataaccgccatatttacttcgacaccatctttcgtgccacgatccacaacaagcatgtcttgccatgtatctggtgaacgattaataacattggcagtaattttttcatagttagtcaatgtttcgtttaactcaagctcttctttcaatgattcgatttctcgcttgtaattttcatttgatcgagcaatctcatcataactatcgattttctcttttaaacgttcgttttcttcatacgtgacaaaaagtttctttacagagtttgcaccggtttcgatccaccgtactggagctgtaatcaccttgtccacgataccaatcgtgtcgttgactgccgattgcacaaaactggatgaattcccaactgctcttctagcaatcgtcacactcaacacagaaacaactaaaatcacaataattaacgtgattatgatatttttattaggattaaactttttcacaaagacacctcaatgagttccaaactgatagccttaattttaccactaaaacgatgtaaacaaaagttaagttgtacgtcttaatgctttttttgtaattagctttctgaaattttcaaaaataaaaaaagagacttgactgtctcttaatctttgctttgaataacagcaataattcccgtttcaaatataaaggatgcttcatccgttatgaattcattactagcaaatgatgtaggatgttcaaccttcacattttccaataggtatttgctttccattaatgaaagattgtcaatgggagtcagacaacaatatgccagatatttcatgcccttttctttacgtatggaatacttacctggcaaaaagaaccgaatgacattttgcttatctaatagactaatattatgagcgaaaggctgaaaccgtttctccagtacaatccataaatttgctaaaaaatgatcgattcttccaccagttgcaccgataatatcaatctttgcattgggaaaatgctcaatagccatcaataatgcgagttgcgtatccgtatcgtctttttctgccggagcttgaaaaaaattttttgcattctgtcgcactcgttctctttcttcagaagaaagagagtcaaaatcaccaatcgcaaaatctaaaggcaaatcctcctcaagcagataaaatgatccccgatcaataccaatgtatttatcatacttctttagagacggccaagtttgctttttgccacctgcaactagaagaatattcatttattacaacacttctttcaatgctttgatttgatcagcaggactgtccgcgtcatagatgtagctaccagcaacaaacacattggcaccagcttctaaacagatccgagctgtttttggaacgattccaccatctacttcgatatcatagtgatacccatttttctctttcaattgtgctagttccttgattttagcaactgtttcttcgataaaagattgtccaccgaatccagggttcacagtcattaccaatacttgatcacacatggatagtacatgttgaatagcggctactggcgtaccagggttgataacaatttccgcctttacattttcatttaaaatcatttgaattgcgcgatgaatgtggggagtagcttcggcatgaactccaattatatcggcaccagcttcggcaaacgcatgaatataattttctggctgagtaatcatcaaatgaacatccagtggcaacttagttatcggacgaatagctttgacaacatttggtcctaaagtaatattaggaacaaattggccatccattacatctatatggatgtaatccgcgccgtttttttctacaagttcaatgtcccgttgcagattcgcaaaatccgcacttaaaattgatggtgctagtttaatcatattcgtttccctcacttatttttctttttataaattggacgacgattttcaatctcctctaaaaattgaacatagtttttataccgggtaagtgcaactgtttgctgttcaactgcttcttttacagcacaatttggctcatttaaatgcatacactcacgaaaacgacattggtgtgccaatgctaaaaattctggaaactgtttgggcaattgtccactatcgatttccaaaaaatcgattgagctgaatccaggggtatcagccactaacccatcatataatgtcaataattctacatgtcgcgttgtatgtttccctcgacctaatgactcagaaatttcggccgtttccaaatctagctctgggactattcggttaagcaatgtggattttcctgcgccagattgtcccataaaaactgtcagtcgttccgggaaaattctttgtaactccagaagatcgctattatctgcttttgaaacaatgacttggtaaccaatttgttggtacaaagcggcaattttttgaacctcactttgatcactcactaagtctgttttactcaaaaagataattggttcaatctctttatactccagtgtaactaaaaaccgatctaatagattaaatgagaaattaggctggatcaaacttgtcaccactacaccttgatccacattggccactggtggacgtatcaattcattttttctcggcagtatctctaacaagtatccatcagttggattactactttcaaaaataacttcatccccaacaagcggcgtgatttttctgtttctgaagtttcctcttgctcgagtttgaaagatagtatcttcagactctacataatagaatccactaagagctttgattatttgtcctttcaaaaattctcctcctcatttctttttattgtaacatatttataactcatgaataaatttctcaccaataaaaaaagcctgaagaagactcttcagacaaaaaaatcgggaagacaggattcgaacctgcgaccccttggtcccaaaccaagtgctctaccaagctgagctacttcccgataatagatattaaaaaaataaaaagactacgcgcccaagaggagtcgaacccctaaccttttgatccgtagtcaaacactctatccaattgagctatgggcgcatattaagaaatgccgaggaccggaatcgaaccggtacggtgatcactcaccccaggannnnnnnnnnnngaatcattgcaaactattcgaatatttggataggtgtcattgtcagtgctgtcgcctttgcctttgcacacagtgacaatcacttgttggtgtatattctattgggactctttttctctggactttatgcgttgacaggacgtatctggacatcgatgattacccacgtgggaatgaatacactagtcattatcattcaactattggttcacgccggttatatcaaggttccatgacacaaaaaaaaaaggctctataatttatgggactgatgaatcagaattgattcttcagccccatttttattttaggtattaaaaaacatatcgttctctagtatgattaaatcacgacaaaataaacaactgagaggacgatatgctatatgaatgattctatcaaaaaaatgctgcgattaatagagaaagatttgatgattacagaggtctcttacgagacctttcagaagaaaaagacgttgatcgtcgatgctgttttcacacctgctccccatacctgtagaaattgtggttctactgtggtagatggaaacgggaaagtaattgtagtgaaaaatgggaagaaggaaacgattgtccgctttgaacaatacaatcacatgcctttggttatgcgcttaaaaaagcagcgctatacctgnnnnnnnnnnnnnnnnnnnnnngaatcattgcaaactattcgaatatttggataggtgtcattgtcagtgctgtcgcctttgcctttgcacacagtgacaatcacttgttggtgtatattctattgggactctttttctctggactttatgcgttgacaggacgtatctggacatcgatgattacccacgtgggaatgaatacactagtcattatcattcaactattggttcacgccggttatatcaaggttccatgacacaaaaaaaaaaggctctataatttatgggactgatgaatcagaattgattcttcagccccatttttattttaggtattaaaaaacatatcgttctctagtatgattaaatcacgacaaaataaacaactgagaggacgatatgctatatgaatgattctatcaaaaaaatgctgcgattaatagagaaagatttgatgattacagaggtctcttacgagacctttcagaagaaaaagacgttgatcgtcgatgctgttttctcacctgctccccatacctgtagaaattgtggttctactgtggtagatggaaacgggaaagtaattgtagtgaaaaatgggaagaaggaaacgatttcatcatctgctcgtctactctgtgcttcgcctgcagtcgcttctaagcatagttcgctaagaaggacttgcatgccatgctttgcatgtcagtcgcagtgattcgggacgtggtgactacgttcccttcggtcgcctagtactgttcatcatctgctctgccatgctttgcatgtcagtcgcagtgattcgggacgtggtgactacgttcccttcggtcgcctagtactgttcatcatctgctctgccatgctttgcatgtcagtcgcagtgattcacagcaaaaagtcgtcccttttatcgttaatgtaacgataaaagggacgactgactcgtgttaccaccctaattcgtgctgcctttgcaggcgtgcacctcaacagtaccaatgatacttggcgcgttatcgggcgcataccgtctatttggcgtgaaccaaataaaaactcagagctcatcttcaacgcctgtctcatgtctcctttttcaccaaccggagtctctgtaccttcaacgtagcgcttactcttctcttcaacgtttcatctctatttgtaatttctaagaattataatcgttctttcattcaatgtcaatccgcttttaagactttggcttatttctttgaaagatagagatattgttgatccatttgttcatagatttcttgcagatcatctcgtgagacttcacgatccttgtagccataaggatcgttgacatacattttgtctccatctattccagtaataacaacggaatggatcaatgtcgtttcgtagatcattcccgattgcgtcggccactcaaaaaaatcagcattggttggtacttgcaattcaagggtagcaatcatccagataggcgtgccctgctccaaaacttcaataatctcatcaaaagatttgtctcgaccacttaccacttgataggaagcccctaccatctggctcgcaactttggcgattggctctaccgcaacccccattgctccatcgccgccataaatattcccaacaaaaccttctcgtgggtctcctcgatgagtttcatctgcgtaaacagggacatagtctaatttggcagccagctcatttttatttgtatcatacccgtagaaattcaacagcatggataaagcagtgacttcacagccatttcctaaatattctggatcaaattggctttccaatggtacatctaatcgaatcacgggctcttctttttctgcagtcagatccagtcctgatatcgaagtcaccgattgtgccgcttgttcttgcttcttcacataaggagttgctccagctttatcatagaaaagccagataaagaacaaactaaaggtgagcagacctaaaagcaaactaatgcttttctttttcatcagtttactcctttcttctttgactattataccttgaatgtcaaaggaacgaaaagaatttatgttttagaaccataatttaggaaaacaatgcttctcaaagcgttgaatccaatgatttagaccatccctaaatgagcataaaaagaagctaagagaacatggagaaagttcccctagcatttatcattacgctttgtatttgttgtctaattctaagaaaggacttgtttcttttttcctagtaatagtttttttgcgcttgaaaaggaacgaatatcgaactgtttgcttagtgccccggcaacaaaataggctaagttataatctatcaaactatggatcaagccaccgatacccatcaagacaaacaagaagtagtaaaaattgccatcaaacgcggtgcctggtacattgccggtaaaatagaaaacagctacaacaagcatttccacaatagaatggataaggccaatcacaagattaaaggcttgaaaacgagcattgaataatgttggcttgccgttctttaataaaatacttggatttttttgtaaataaaatgccccgatcacggcaaaaacaacgtgcgacaatgcccgcaaagcaatgatcggcggtaatgtgataaaaaagccaaatgtggtacctaaagctactgctatcgccatccctggtgaaaagaacatcgccacaaacaatggcacatggctagctaaagtaaaggaagccggcccgatgacgatcttgggcatcaccattggaataacgattcccataccaatcaaaagtgctgcaatcgttaaatgacgtactgaatgtttcttcatgaataattcctccttcaatgtgtcttgacacatttatctcgctcattgtagcttgaaaacaccaaggtgtcaagacacaaaaaaacaggacgatgacctaagtatgaacagacaaaaatacctgaaggagataaggtagcgaattctgttaaaagtgccccttgaaccaacgatacggttggaataggtcctttcccctttccttcagatattcagtttgttgcctcacttatgccacagcccctgctgtttcattattcatttatttcaagtccctttttgtgcgccagcatttcattgctcaaacgtgcgaattctgctaatgacaatgtctctccgcgacgagttggatcaatttcactggcagctaaactcgctttaagccattctttcgttttttcatcttttccataggaattctgcaggttattccacaacgtttttcgtcgtaattggaaggctgccttcgtcaacttgaagaattctttttcatctgttacttcaaccgcaggagttgcacgacgagtcagcttcaagattgcggaatccacatttggttggggcacaaaaaccgtcttagggacaatgaaagcaagctctgcttccatgtagtattggacagcgatcgataaagagccatacgctttcgttcctggaacagctgaaatacggtcagccacttctttttgcatcatgacaaccatttcttggattggtgcctgtgattctaagaaatgcatcatgatcggcgtcgtaatatagtaaggaagattcgctacgactttgattggccgttcatcggtaaaagcttctctgatcattgtagacaagtctgcttgtaaaacatcttgatgaatcacttgaatgttcgaataaggagccaatgtatcttgtaaaactggaatcaaacggtcatcaatctcaaaagccaggacttgacgcgcatgtttcgccaattgctcggtcagagcgccgatccccggtccgacttctatcacatttgtttgatcatcgattgcagcagtcgcaacgattttgcgcaaaatattaggttcagtcaagaaattctgccccaggctctttttgaaggtaaagccatgttttgctaatatttctttcgttcttgatggggttgcaatatccctttgttctttcacaattcttcctccactatcttcattgcttcagccaattctgtttcagtaatacgaaacatggcaagacgtttttccaactgtttggcattcgtataaccgattcgtaaaacatctccgagtttttcccgttttgctcgtgcttgctcaccagcaatcagtccatagcttgctaaaacttgacgagaaattttctcactctcgtcttcatcttgttgactggctggcgtgacgactttgcgaagtgcttctctaagcgcttcatcactagcgtgttccacacctaaactgccctttttctttggtgcagcttggcttcgaggcaaaaaggcatgttgggcagccgggacagcttccattatgattttacgaattttttcacccgaaaaatcagggtccgtaaaaacgatcacgccacgagtctcttgggcatgttcaatttgacttaagatggtttcgtcaatcgctgatccgatcgtttcaatcgtatcgacatcaaacacttcttgcaatcggcgcgtatcgtctttcccttcgacgacaatgatctcttcgattctccatctatccttcataaaggttgaacaacttctcagcattgatacacgtttgcttggcgacttcctcaaaagacatctgacgcagttccgcgattttttcgactacatagcgggtataccctggttcattgcgttttcctcggtaaggcattggtgcaagataaggtgcatcagtttcgactaatagacgatcgatcggaaccacttgcgcagcttcttggacatccaacgcctttttgaaggtcactacaccactaaatgaaatgtgcatacctagatccaaaaagcgctttgcccattcgccatcaccactgaaactatgcatgatgccgccgatatctgtgattttttcttcttttaaaatctggtacgtgtcttcgatcgcttctcgggtatgaatactgataggtaaatgcatctctttagcgatcgcgatttgccgacgaaagacagccgattgtacctcttttggatcttccatccaatgatagtccagtccaatttctcctaaagctacaactttgggttgtgtcaggcgctcttggatgaatgcctcaatctcttttgtgtaagatcccgcttctgttggatgccatccaatgatactgtatatcccatcatattcttgacttaatgccaatgacttttcaatcgtaggttgatcaaatccgacaactgccattttcgttactcctagctcgtgagctctggcaatcgtttcgggaatctcttcattaaattgttctgcatttaaatgcgtatgtgaatcaaaaatcataaaacttcctccttgtttcctctatactctagcatattttgcggctttaagaaacgaatccttcttgttttttcatttgctaaagaaagttttcagcaatcaagaaaaatcagcccaaaggtggagggagaaaaaaagccagtcgattataatagacctatgatccatcagattcggaggtgaaaagatggaaaaatcaaaaccatttacaaaatgtactttacggcaacgctatcactattatcgtcagcaaaatgctcatcaacaatttaacgggaattttcaacaaaacttccaaaaagatttcccaagttttgctaactggcttaaattgcagcaaaagccgattgccaaagatcaaacagcgacattttctcactggttcttactgattctatttagtttagtgactgtagccacatttacccaacagctcttatttcttttatttgtttttgtcattgcagcactagtcaaaggtcctggaatgattctctggggagttgtctattcgtttctagtgacactctttcctcctcttggtttgttgctttcagcgcttttctttctgctcactctcaggcagttgacaagaaacttgacctttatttttacagctgtgtacttttacagctaccctttcttgatcacagcgattcatcattttacaacattcgatgatcaatggatcatgattgcagcggttatttttgccttgatcagcgggcatcttttgtttaagcgaaattatcagtttgcctctagtaaagcagttgcttggcgactgatcaccactccttatgattgtttgactgcattgattccttcaaagaaaggacgccgattacaacgactgcgaaacaaatgatttttcggaacctaaagcttgattccacgctgacattgaaactgatttgccaacatttaagatccatgcctagtggaaaaggacgcggacatgaacacttagacttcctacaaagggcttctgcaatgcaggagcccttcgcctattatttaagatgtgcttgactgctgctcttgttatctaagctggatattttcatcgttaaacaaaaacaatggaaaaagtaaatttgtttttttattttttgaaaatcaataaaaaaaaggaaaaaaatttttactgaatgtcttttgtttgattgcttttttggggtgaatctactatgctattagttagctaaacaaaaaaggagacccgctatgctgaccttcatttttatcttttccttccttgtgggcttgcttttttacgcctttattattgagccgcgccgattaaaacagcggcattatttgatcaaaaaagaaaagcaaacggtccttgatatttccaaagcctatgatctttatcaaaatgaacagaatgtagtagtcgcacatatcagtgatctacacttttctcgttggttcaaaccgcaacgcatcaatcgtatcatccgttccacgatcttaaacaaacctgatttgatcatcatcacgggtgacttgatcgacaattaccgtaagtggcctcaccgttcaaccagccgcctcattgaaaagttaaagaaattgaatgcgccaatggggaaaatcgctgtattaggaaatcatgatcatttgaatgatgggcaatattttgtgaatgaagtgtatgaaaacgccaatttcaccttgttggacaatgaatctgtatttggttctgatgagaaaacctcgatgaatatcgtagggatcgatagtgcgagcaaaagcgcccactaccattacgagccaaccttagcagaatggcagattctcttgatccatgaacctgactatgtctctcgagtagacaacattcgtgactatgatctcgttctatccggtcacagccatggaggccagattcgtgtgcccttttatcgtgcgaaaacgaaaggcgccctcaaatacacagatggtctctatcttttggccgcgaacacacttctaagtgtgtccaatggtgtggggaccacggcgattccagcgcgctttgctgtgccgccagaaatcacatactatcatctcgtgcccgccgaaaaacatgctgtagcctaaaacaagctcttaagtgatcctcctatctcgtttggatagttaggatacttaagagcttgttttcgttattggcgtaatccgttatagatcgtctccaaattccacttcatcatcgcataataactatcgccatcttgtccaggttcagcgatggagtctgtaaagacagtgccgtagatcggaatacctgaatcccgagacacgctttgcattgggcgagtattaacgctactctcgacaaacaatgaaggaactgccgatgcttgcaattggtcgactaaattcttgatctgagcaggcgttccttcttcttcggtgttgatttcccagatataagcggatggcacaccataggccttcgaaaagtacttaaaggcgccttcacttgtcacgatcaatttcttttcttcaggaattgaagcaaaattatctttcgcttgttggtctaattcggaaagctgctgcagatagtgttccaagttttcttgatagaccccctgatttgcaggatctttcttactcaattgttgggcgatatttcgcgcatagatcatcccattttccaaattaagccatgcatgaggatctgcctttgtatgatcagcatcatccgatagatacaggacttctacgccatcactgacggcaaaataatcttcacccgcttttttgttggcgttgttcattaatttagtaaaccagccgttgccgcccgtctctaaattcaagccattataaaatagaatgtctgcatcagtggctttttggacatcttctgacagtggttcatattcatgagggtcacgccctacaggaacgatgctgtggagattgattttgtccccagcgatgtttttggtcatatctgctaaaatcgaattggtcactacaacatttaatttgtcatcaacggttgccgcctgctctgcttgctgataaatcaagaatcctcctgcaacagcggcagcagaaaccattgccgtggtcagccagcgtttggcaggactcgtttgttgttttggtgaaaagagaaatcctaagacaaacaaaatagctgcagtgaggacaatgcttgatccggctgcaatattaaaggaataaccgataaataacccaatcacagaagaagcaccgcctagaatccctgcaatcaccatcatatggctaaggcgttttgtaaataaataagcagttgctgctggcgtaaccagcaaagctacaatcaagatcgtaccgacactttgcatcgcagtaacggaaactagtgtcaaaagcagcatcaacaagtaatgatatacctgtacattcattccaaaagctttcgccatcatcggatcaaaagaagtgatcagcaatggccgaaagaagatcataatcagtgcaatgaccagtaaagcaatcgcaatcgtgacccatttatccccctcttggactgcgagcacatttccgaataagatatgaaacaaatccgtagaactgttagctacgccaatcaagatcactcccaaagctaaaaaggagctgaaggtgatcccgatcgccgtatcacttttgatcaaactattgttagaaatataggtgataatgatcgatgcaagaacaccaaagaaaattgctccaacaaaaaagttcacccctaaaatataggataatgctactccgggaagtacggcgtgagaaatggcatctcccatcaatgacattccccgcaaaataataaaacaaccaatcacccctgcaacaacaccgatcgctacggcggtgatcaaggcattttgcagaaaatggtaatgaactaatccatcaataaactgactaatcatcttaagcccctcctttcacgatgatcgtatcgccgaatgtttctttcaaatttgtttcagtaaaaacagtcgtcgtcggaccatatgcgattaaatgctgattcatcatcactagttcatcgaagtattcagtcactttgcctaaatcatgatgaacaataaaaattgtctttccttgttggcgaaattcacgcagaagtcctacaataattgcttcactcatcgcatcgattcctacaaatggttcatctaaaaaaatgaattccgcttcttgcagtaatgtgcgagcgatcaatactctttggaactgaccgccagatagttcgccgatctgccgttcagcaaagtcagccatttggacagactccaatgcagcggcgactttctgccaatctttggccgttattcgttgaaacagagaaagctgcggatagagtcctaatgacaccacttcttttactgtaatcggaaatgtataatcgactgcagtcttttgttccacgtaggctatctttttttggaacttattgagtgccattccattcgatgtgacatgtccttcagaagggatcagctgcagtgcagctttgatgaaggtagattttcccgcaccattcggtccgatgatccctacaatggccggcttatcaacacagaaagatactccagagacagcttgatttttcccatcatagctggcggaaatttttgaaaatgtgatcatagtttgcgctcctttacatttatgttaaagtatcgtttatttattttttaggcatgcctaatttatttccaattataccgattctcctgttgaatgcaagggattttttacacaaataaaatccaattagaaaaaataaagtgtcccttcaactaccttgcccctagcagatcgttttattcattcgccgttacttttagtgtgaccaaacaaaaaaagtttccactcctttgagggaaactttttaaaagaaaactttctaatcagcattcgctgtttttttcaaaatttgtgatgaagaatcaacctggagtaccaattgtcggcaatatactcgtcactactcagacactacgttgactggttgattctctaagaaatgcttataatttgagacagcgatagctagcaatcgttgccgggtctctaatggtgcccacgcaatatgcggcgtcaaatagcagttaggcgcatgcaacaatggattgtcagccgtgattggttctttcgaaacgacatcagctgccagagcagcaaattgtccagctgacaacgcttctgctactgcttgttcatctagtaatccaccgcgagcagtgttgatcaagataacatcctttttcatttgagacaatgcacgggcgtcaatcatcctctcagtatcgggaaattgcggtacatggagactgatcacatctgcttgttgaaagagtctctccaacgaaacttgttctgcccattcagcctgcggcgtttttggtcgatgattgtaatagatgaccttcatttgaaacgcatgagcaatttcagcgactgcctgagcaatcgcaccatagccgatcaaaccgatcgtcttgttggcaatttcagtcagtggcgtttgccaataagagaaatcgggactgttttgccaatctccttgatggacggattggttgtgccgccctacttgattcgttacctcaagtaataaagcaaatgtagcttgcgctactgaattcgtactatagctgggaatatttgtgacggtaatcccttgagatgctgcagcttgtaaatccacaacattgtagccagttgccagcacgccgatataatcgatgttagggcatgcttgtagtatttcctttgtaaggggcgttttgttcgtaaaaacagccgatgctttgccgattcgctcaatgatctccttcgtatctgtataggaagtgcgatcataaatcgtgatttcccctaatccagctaatggctgccaatctaaatctcctggattcaacgcatagccatctaaaacaacaattttcatttttttgctcctctctgttggaaataaaagactggaatccctaaacaggtgatcaaaataccgatcaatgcaagcacaggggccgtaaggatcgtcattattaaaatgaatccgccccctaaaagagcaatgatcggtgtgatcgggtacaacggaaccttgtatggacgattgagctcaggtgctttttttcttaacaagatcacacctacaaacaataatacactaaaaaaccacatcacaaaaatcaacatatccgttaagagatcaaaactacccaacaacatcattaaacacgcaattgctaattggaaaaaaaccgccgcataaggagccttggttttatttgtcaatttaacaaaggtcgaactgaatggaacttcattctcgagtgccatggcataaggcacccgcaatccggtcatcgtatacccattgagtgcgccataaactgaaatcaaaataccaatcgtcactagtttgcccccaaaatcaccaaataactgcaatgcggtttctgaagcactatttaagtttccagcaatctgttctaagggcaatgttttcaagaaaacaagattgatcaggagataaaccaaggttacaaaacttaatccaaagataatcgctttcggaagatctttttccggccgcttcatttcaccagcaatattcccaacacctaaccagccatcataagcgaagagagtcgctagtaatgcactgctgattcctgcaatgatcgaaccatcacttgttgtagaaaaattgattaccgagactgacactcgtcctggtgtcatcaatcccactaaaacgatcaatgcgatgggaatcaatttgattgataatgtaaatgactgtacgcctgcggcggtttttgtccctaatagattgaacaaactaacactggtaccggtgatcaacgatagcggcaagagataacttgcgggcaaatgaaacagattcaaacactgagtggcaaaaataatactcaacgctgctatattggcagggaaataaataatgctttgagcccatcctagcaagaaagaaggcaatttcccgtaaattcgttcaatgtagcgaataggaccaccagtttctggtattgctgttgctagctccgctaccgttagtccgccacagatcgtcaaacagcccgcaatcaaccacacaagcaatgttaagccagaggattgcgtatgttggaccactgcagccgctttaaagaacaccccggctccaatcacagttcccatgactgtcgaaagtgctccgaaaaaagtgatttctttctttagttgactcttcaaatactcacgctcctttttttgactaaatcaaagtatagcggatagatgctttgttggctagagtgattcgtttggaccacaaaaaaacagctgcttttcaacagctatccctcttatttatttactgttgaaaccaaaacttgtgtacgcctttggtgcattcgtttcactaagaaaactgcaagcaacaagatcaaaggaaagatccccgctcccaaaattccttgctgcaaacctttgtcgctgccttctgccaacaaaccgaccaatgaaggtcccaatgaacaacctaaatcacccgctaaggctaggtaagcaaacattgctgtacctccattacgaatgtattttgtcgttaaactaaaaattcccggccacaatataccgacagcaaatccactcaatccacaaccgataaagcctagaattgggacacttgataacccgatcagcaaatacgccaccaagcatagcaataagcttgcaaacataaatttccgtagatcgatacgttcgccaaatttcccataatacagacgagcaagtcccatcatgatcgcaaacaacattggtcccgcaagatcaccgaccgttttggacacaccaagtccttgctctgcaaaagtggatgccgattgactaactgattgttcacttgccccggcacagaccatcatgactagaaacagccaaaagcttttcaatgagaacagttcacgattcttcagtcctacttcgccttctgctacgattggtgctaatggaacttgagtaaaaacaaccaaattgaccagcggcaaaatagcccagatcaatgtaagaaatggccaacgagcaataccgaagacaaagaaaaagagtgttgagactaagacgaccccaacatatccccaacaataaaacgaatgcagcatactcatggttttttctttattcggggttggacaagcttcgacgattgggctcactaatacttccagaagtccgccaccaattgcatagaggaagactgccgtcaataaaccggtaaaaggggtcggaaagataagtggaaaaacagccaacccaatcaatcctacagccgcaaaaaaatgcgccgcgacaatcgagatacgataaccaatccgatcgacaaaaaagatcgctgcaaagtccacacccagctgcgttagaaaattaaatgtaaccaaaagcgtgatttgacttagcggaatctgatactgtgtttgaaatgtcaaaaataataaaggtgcaaagttattgatgattgcttgaacaatatacccagcaaagcaagcaatgatcgttcgttgataatttttcatttttacctcctccagatttgtttagtatagcaagagaactttcacaatcgccatggaaaatgctattcaaattgctagagtatgttctcttttttggtgtattatcagttgaaaattgctccctactggtattgcaagtcagatctcaataaagttagtggtgataagtgctagtatcataaaaaaaaacgaatctcccctgccgatttcagcaatctggaaatatcgtttttttttttgaaacacaacgattgaagatctctactggctgaagatccttggtcattgtactaattctgtccaaaagttcttttattttgaataagttgtccgaaaaggattatacttgcgcttttcagagacagcagattagttggaatgtgctgccagcattttgactgtggcttcaaaaattggtccaataaagatgatacagagcaatgtaccgataccgacattggcacccaaaccaaagccaatcaagaccatcgctgcatccaagccgatccggatcgtcttttgggtcagcttcgtacgtttataaatcagcgcagttagtgcttctaatgctgctgatccttgatttgaagagacatagatccctgccccaacgccgaacaagatgggggcgatgaaaatcgccaaccaagaatagaatggcaaatgaacaaaaatcttatccataaccggctcaaaaatcccaatcagcaaaccaagaccgatcccattgatataactgccgattccaagctcctggcgatcgaaaatagctacgatcaataagacgaccagattaaaacatagactggcgatccaaaacggaacagacacatgattcaagattcccagcaaaaatgtactgatcgtatcatacccctgatgggcagtgatcagcaatgaaattgctaacgcaatcaaacacgtacctaacaagatttgccaaatttttttcacgacatcactctcttttccaatttagttttctagactctcttagtgtaccttgccgtttcagagattactactatttcttttatctgtctaaaaaacccttcaagcggtcaatccagtgattcgtaactttgctcatacttctctcgaaattcttttggcgtcagaccattcaatttcttgaacatctttgaaaaataattcgtattattgtatccgatcacatcggcaatctcattaattgtttgtctcgtatgcagcagaagctgctgagcttttttgatccgaataaaattgacgtattgattaaagcttaattccgtttcttttttgaacacttgccccagatagactacactaacatgcagagcttcggcagccgatttaaccgtcagctcttgtgtatagtgctcttcaatcatgccaaccgctttttgaacaatctcagaataacgcttttgctgaggctggtctttggccaactgcaaaatctcgttgaagagctgacgcagtacctggatcgtattcgatgctcgaatccgagtgatgatccgatcataattttctctagtcaaagcagggaactggcggtaaatatcattgaataatagaaaggctacgtaacggacatgctcagggtcagcctgcatcccctcgagacttgaaaagattttgtctaattcatcttgaacggtttttgtatccccgatcgtcaatgctttattgaaagagagaaaaggtagcgcttcgttgcggtctaagatatcgacttgaatgatttgttcattaagcagcaaatccgggtaaaagatctgcagtgattggacttgcttgattttctcataccctttgtataagttttcccattcattgatcgtttcactgaccaccaattgccaatttcctgctagaatcgctgacagttctttgagcagacaccagagacgttgacgttcaccataaaaaacgatcagcaactgattctctcccaatcgtcctggcagtagcaatggctgttctttttcgacaaaaaaacgaaacccattttctaagatttcaggtgtccctgtcagctgtagaatcgtataaggcggatggatgggttgtgtggactgttccaataataagtggtactcactttcatttaattcatcattcagccaaagcaacaagctggattctcgatacaagtcattttgttcatcgattcgttgctgatgtgccagttcctccgcaattgcctgcacactttcatagagttcgaccttgttgactggcttaacgagataatttcggactcctaactgcatgccttgcttcacaaatgcaaattcttggtaaccagataagatgatggaaaaaaaggtattgccttttgcctgtgctttagcgatcatatcaatcccattcatttccggcatgcgaatatcagtgatcagtagatcaatggcttgtgtttctaaatattccaacgcttcagaagcgcttttagctgtgtgaacgacttcaaagcctaattcttgccaaggaatgatcatctttaggccttctagaatcatgtactcatcgtccacaaacatggctttatataaactcatcattcaacatctcctcatcgatcgcaatggaaatcttgaatccgtgatttttttcagattcaacttccatctgataatgatcgccaaacatcccccttaatcgttcatgaacatttttcatgcctatggatgtttgtacgacgactcggtcatctgcaagctcttggcggatcatcgctaattgctctggatctgctccttttccgttgtcccgtacttgcaaaagaatcttgccattttgtcggaaggctttgatactgatggcattatcatttcgctgatagtcgattccatgcacaaaataattttctactaaaggttgcaaagtgaacttaggcaagagcagatgtttcagatcttcttcgatagttacgtgataggcgattttatccggatacctcatttgatacaagtaaacgtatttctcacaaaacgtcacttcttctgccaatgttttgatcttttcctgtgtcgtattgttgcgcaaaagtgccgaaaaagcgtatacgacatccgctaattcttcctgctggcggctcaatgcgtacatccgaatgtattcgagtgtattgtataagaaatgaggattgatctgagcctgcaatgcccgcatatccgcatcccgctgcttgatttccagggtatagatgtcctcaatgtagtcattgatactgcctgtcatttgattgatcgcctcggcgattgtttttaattcttgttgaacccccgtggtatcaatacgctcattaaaatctccgtgactgactttttgggttgcttgaacgatctgtttgacctgctgggtgtaacgcttgaacgtacgatgcaaaatcaatagcagcacaaaaagaatcaacgtaccgcaaccaaaaatcaacaatgtataatttaggacatcccgccaaatcgcttgcttatctagtaaaaccagcgtgatttctccgttgatattcccttgtttttttatgtaaaaatcatgggacaatttcggcacgatctctttttgattattggccattgcttgatcgattttgtcgatcatcgcctgattcagattcggtgcatctttatagagacgctgtccactgcttgtgtatatgaaacttttgataccgtgttctctattttcatcactacgattagctaatacgttttcttcattaaataccacaaacacttgtcccattggttgcgcaaaattactcggttgtgcgatcgatcgcgcaaaatataggcgatttttcaattggatctggtcgccccgcagtttctctccgtaaggtctgtctggtgtagcaactaaatattctttgctttcatccaattgaacgatgatttcttcaatgtcaggatgactgctgatcaaacggtaaaggatatttggcagataaatattttgtcctgattgtcgaaacatatcattactataggaaaaataatcggcgatcgataactgtaaatagttgcgcaatgattcaaaggtggcatccgaactggtgaattctcctaatacttcagaaacaatcgtattacgctcttggatatacgtatctaaatacgtgcttgttgcatcgacgagtcgattactcatccgaaaccgatccacacccgtatagacactcaaccctaacatgatcaaaatcgaaatcagaatcaacaaggcactataaagctgcatcaattgattgatcaggaagtcacgcttgaaaagggctaagattcgtttattcatattgcagttttccatcgatcaatgcacggtctttccgggaagcggaatggacccataataagatcaaactgaaggtaccaaataaaaacaatcctttcatgctccaagtaaacaccaaaatacctacgagaccaaaaatgactttagcgaaggtgccaaaatttagaaataaactgacaaatgccagtttgatcgtattcaataaagaggtttcataaattgattcaaacaataaactatacaaatacagtaaaaccaagagaccacttactactactagcaaaaagtcgatcatcagccacagtagtccttggatctgactggagagatacaaattatacgctgcgatcgccagcaaaccgaaaaataaataaaaacgggcgttggctcgccaaaagttttgcttccagcatcgaaaggccttcctaaacgtttggtcctcgtaagataagccctcttcttcgatcaaatcactgatggtttgaaatgccggaccaaccccaaacaaaactgcgcccatcattgtaaacaatacgaagaaaagattcagtttaatgaccgcccaaatcagacgaaaggcctttactaatcctccacttgttgtctctttcattctttctcatcccctcttggtatttgcccgttttattatagcgtttttttgtcacttctcaaaatgcgaatctttactttttctgacgcttatcgccgcttattctatcttattctattatgtacaacaaatgaggagtgacgaaatcattcatcggctactcctcatctgctcctacgcgcagttgctccgcttattttaactaattattttccagattcacggtattcgtcgaattgtttttgcatttcatcacgaactttgtcccaaccagctgttttcaattcttccactagttttggcacattttcttctggatcaatcgtccctgttgctagacttgctttataacgattcatgacattggcgatgttggtgatttcagtcttcacactatctgttttaaagttgaaacctagaatcggtgattcttcggctttagcaatgttttcgtcacgttctttgatcatttcatcagtgatcgattcttgcgtatacaagatcatattgttcccagtattccatgccgccatgtgagtgtttggtttgtaaccatccaacaatttgattttgttatcttgcccttccactttttcccatgcttctccttcaacaccccagacaagtccattcaacaattcagggtcgctgtttaacaaaccaaggaattcgacagctttttctttgtttttagaaacatttgccaccacaaagttcgccatttgggcttgccctgttgatttcaattgtttggtaagcggacgagaaatcaattcgtgaccggcagcattgttcaaaattgtatcgccgtaatccattggtccttgggtttcttcacgcatgaaccaagtatttccttctaatggatagccagtggtattggttgcggcatctgttgggatcaatccttctttataccatttgtgcatcaatttcaagtttgccatttgttcgtcatcttcatatgggttgatgatttttgtagtgtctccgtcaagtttgaccgcaaatggatagtctttccccatgacatagtcatagtttcctgaaatgttgaaggtttgaccaattgcgaagctggcaatattcggttccttctcatggaattttttcaaggcatcttctgcatcagcataagaattgatattgctgatatcaatgtcgtatttatcgagatattgtttgttgaatgtcaatacttgttgtgcatacacgtttccattaacaggaaaggcatacagcttgccatcgatggtgttgcctttgatatatgcttcatctaattgatcataagcttccttagcatattttggtgcgaggtcggtcaaatccgcatatgctcctttttgggcatttgccacaaaattagatgcaaaagagatatcatagttctcgccagaagaaatgatcgtactcattttttgatcccaatcgccccagccaatgtactgtaggtcgatccgtgcattgattttttcctcgatccgtttgttggcgatctccatcaattgatcaaagttctctggtttgtccccgacttgatacatcaacaaagtctttacgccatccgcactattagaatcagaatccgacgactccccgtttgacccgcaagcagctaagctcaacagcattgctgaagcgaatcctgcaaacattgtttttttccacgatttcatttgttttcctcctatatccttattattctttgacaccgccaattgtcaagccacccacgaaatatcgttggaaaaatgggtaagtaatggcaattggtaatgttgctactacaacgattgccatccgagcagtctcgtttggcaatgcggccaatccaccttgaacttgagcagccataccggtacttttagctaaataatccaagttcgattgaatccgcatcaatagtgcttgtaacggcactagtgaatccttttgaatgtataacaatgcattgaaccaatcattccagtaaccaagtgccgcaaataaactgatcgtagcgattcctggaaccgctaatggtaagacgatcgagatgaaaatcttcatttcgctggcaccatcgatccgagctgactcaataatactgtctggcacagtcttcttgaagaaagtccgcatcactaaaatattgaaaggacctaatgcaatcggtaaaatcaatgcccaaatcgtatcttttaattgaatcaaattaaccattactaggtaattggctaccattcctggggcaaaaagcatcgttaccaatgcaaagagcgtaaagaatcgccgaaatgggaaattggaacgagaaatcacataggcatacagtgaagtcatcgttgcattgatgactgtcccgaagacggtgataaagacggagatcccaaatgcttgaaaaatcttgctgctcatggcgccactaaagagatagctataggcggcaaaagaaaattcaccgggccaaaagcggtagccattctcagctagcgaggtttcactcgtcagagaaattgcaattacaaataaaaatggtaagacacaagaaaaggcaaatagcgccaaaacaatattgaaaatcaggttgaccgttggattaaaggaacggacttcgacctttgctactttctttttcattcgtccatcctccttagaataatgctgaatctggttctaatttacgtaccactaagttggcagctaagagcaagcacatacccactacggattgataaagtccggcggcagcagtcatgccaaagtcacctgtggccgtcaagccgttatagatgtaggtatctaaaacggaagaaacttgatacaatgcacctgagttgcgaggaacttggtagaatagaccaaagtcggcccggaagatcccaccaatattcaaaatcaataagacagagatcatcggcaataattgcggcagtgtcacgtttttgatttgctgccatttattggccccgtccaccattgctgcttcataataggtttgatcgatacccatcaccgatgcgtaataaatgatactgttgtagcccaagctcttccagacgttcatgaaaacaaagataaatggccaccattttggatcggcataccagttgattccttcaccacccatgttggtgatccattgattgataattcccttgtcagggctcaaaaaggcatagacaaaataggaaataactacccatgaaagaaaataaggcagcaatgacatggtatgatacactttgaccaatcgcttgttccgcaattcactcatcacgatcgcaaaggcgatggcaaaaaatagattgaatgctagaaacacgatattgtaaagcaatgtatttctagtgatcagccaagcatcatttgatgcaaataaaaatttgaaattatcaaacccgacccacgggctctgttgcagactggcaaaaaatccgtctggtgaaagacgaaaatctttgaatgcaacgacattgacaaatactggaatatagaaaaaaaagatgaaccaaatgacaccgggaagtgccattaagataagtgctttaaattgccacacatttttccaaaatccctttttcttcacatttgatcaactccttctgctataagaataacgctttcattgtgaataattaaggaacaaactaaagataaaaagaaacaaattaaagattttgtcttttctattatcttttgtatgattttccccatcgatcaaaagacaatttttcttcacaaaaaaacaagcagcacgtattgctgcttgttttactttttttattgggcttcttttcctaataacagactgccaataatgccgcttttgttcggcagcccccaagcaacaatgtattctgtgactgtcggtgtttccatgtaaccagccatttgctcagtaaactgatcgtggattttcgtcaaaagatgcggttggttcatcactccgcctcctaatacaattcgatcaggggcaactgtcaaagtgatattcacaagtgcttgcccaatataaaaggcttgtaaatcccaaatctcatgatcttttggcaaatgttgtcctttgatacctgtccgtgcttccagtgagggaccagctgctaacccttccagacaatctttgtgatagggacaggtgccgacataatcgtcctgcggatgccgtttcacaaaagtgtgcccaacttccggatgacctgcgccttggaagatttcctcattgattacgattccagctccaataccagtgccaatagttagatacacgcagctgcgcattccttgtgctgcaccttgtttgagttccccaaaagccgcagcattgacatctgtcgtccaggcaaaacgagtggcgggataccgttttttcaaagtccctaaaaaatcaaactgctgccagccttttttgggtgttgctaagattttgccatacgtttcttgttgaggatcgatcccaatcggaccaaatgatcctacccccatggtggctaaggtgtacttatcaaaaaaagcaaaaatagcagccatcgtttcctctggtgtcgtcgtaggtagtgagcactcatcaatgatagatcgttcatcagcgaccgcacaattcatttttgttccaccggcttcaattgcaccataaaacatctttttcactccttcaaaccgattgttcgaatttcataagcagccagtgtttctccaactgattgaggctgttcttcttccaacaaattaagcaggcaacgatctgtcttttctttcttcgcgacaaaaggtgttgctgtatcggcaagattgtaccctcttagaacgagcaagtcatcttggcgacgacgtttaagagccgtgatcgccactgtagcgccattggcttccacgaattgtgactgtttttctaatagacctgagtggatggctgtttgccgggcgatccaaggcacttgagctgcttgtgcttgtcgataggtttcgtagcgttcgttggcttgagcatgcaactcaatcccgtactcaaacgtatgcttaccgatacattgcgcttctggtgttgggaaatagccccaatcgccaagttctcctgtgcatcgtaacaacgtcaaacaaattttgtcttctacgatctcgtattcatttaatccagtattggaaactgtgacgccgaaatcttcctcatgtaaattaacaaatgcgtgttgatgctgcggatttgtcggattttgccaatgactagagacttgattcggccttctaactgcttcatagatactatcagcttcatgttgatccgtatggatacccgtagggaaaagcgcccgtaaccggtggtctttgctttggttgttcactgtcgttttaaaactgattcgtttactgttgcagtccaagcgaatttctgtttccaaggtaaatggcactgtttgttgcgccctttgtgctttacggaaacggaaatcaacgactgctttttgttcttcaagtaattgctcatcagccgatactggaatttgcatcatctgcgttactttaacgacgccataaagagcagaatttgcgatgacctcaatttgatgaggaaaagctgttgagtaaatggcgcggtccccttcaggttgtttgaaaatatactcattgccgatatcgccaacatcttcaaaaaccaataaatccgtcaattctttcccggttgctttttctttgatggtcagactgccgtttgaagtgatcgttgcttggacaaacgcgttttctaaaacacgaccatctgctgaaacgattttttctgtcgtagatgctacttgtggcttgtcagcctcaatcagtgcaaaggtctgccatgaaaattccggcatttgatccatttggacttgtacattgacaaaacgcttcataaaaggaatccgaaaagcgtctttcggtaattcatagtcaaaaagcacttcttcttcgctgatttttgccggtaagatctttccttcagaatcaatgatttggtaagaacctttaggctgttgctgcaactcttgatataaccggctaggaagcccttctcggaatgttttccggctcagttctacttccacttcaacgatgcccgaacgtgtcgtccctgaggtattaaagactacaaatggtcggctttcttttggaaaagcggaagtatcgatggcatttagcaactgtgctactgcttcatcagcgacatatttgccgatttcattggctttttcaaaccgcggcatcatctcccgatgcacttcgtccaccgaacagccacaaatactgtcatgaggatgattttgcatcaacagtttccaagcgtggtccagcacatcgtggggatacttcttcgttacctcatacgccatcgttgctaatggttcagccacattttccaattgacgtgagacgcgcgtattccattgtttcaaataaacccgcgaggaggccgtgttggctagcgtataccagccgtctgtctcttgacttgtcaattcgccgctcacggtcccaaggtctgctggcaaatccgcttgaactgctgcaaggtattctgtgaacccagcatgcttgaattcataatcagggaacaattcattcgctaagcggatcgcttcactgatatttttttggacaggctgatgatccaccccattcatcatcaagtaatgatttgtcgaaccaaatttctcaacatcttgcaatttttgagtccaaaactggtgtgcttcttcccgatcaaccggaatctcattgccattggaataccagttggcaaaaagtagaccaaagatctcactgccatctggacctcgccaattcatttctgagtattgggaggtaaactgatcatccggtaaaacttcgttatcaaacccgattggcttaactcctcgaccaaaagctgcactgtgtaagttggcttgcttcatcatttgcggtgtttggcccatattcccgaatgtatccgggaaatagcccagcatgacgggtgttccccattttttgctttcagccatcccaatcaacatgttgcgggtattggactctgaactaatcaaaaagtcatcttgaagaatataaaagggaccaatttgtaattttccttgatcgattgctcgtttgaccgctgcccgcttttccggacgaacttccaaataatcatctaggataatggtctgaccatctaaatgaaaactgtggaactcaggatctttctcaaacaattccaatagatcatccatcaattcaatcaagcgcatatggtgttgctcataaggcatataccactcacgatcccaatgactatgagatacgatataaatttgttttttcattgtctaactcctctcgtttttgccggagatgcttatttttctactcgaatatcaaagtaatccatgacaagctcacaaaacatcatattggcccatgagaaccattcccgggtatatttcgtcggatcatccacatcgaatccttcatgcatcaaatgggtgccagcatcggttgcaactaattgattgaggattcgttctttctccgccttatctggtgtcgtcatgccttccattgccatcgcgatcggccacacatagttttctggtgtatgagagcttccgattcccttcgcatattttccttcatagaagtaaggattttcggaactgagcaacgttttgcgtgtggctaaataggtttcatcttgatctgatccgtaacctaaataaggggcggcaaccaaattcggtacgttgctatcatccatcacagtggcattgccttgaccatcgacttcataggcatagatcgtttgacccgcttgattggtggttttgccaaacgcatcgatccctgcttggatctctgattggagctgttttgcttgagtaacaatcgctggttcattcaagatagaactaaaaatctcaacaatgtagcctaaaaccactacagcaaacatattcgaaggaaccagataaccataagcacatgcatcgtcactgggacgaaatcccgaccaggtcataccagttggtacgacaggcgctcctttcccgtcattgatcaaggtatcttctttacgccatgtttctctctcaaagcgataaggagattcttgatgattttgttccgtggcaaaaacatgaagggcttttttgataccgctcacaaaatcgtcattaaactgatctgttctgccagtattcttatacaacaggtacgccaattgaatgggataacacaaagaatcgatctcatattttcgttcccagatccaatcattcatctctgtcaaatcgctttgatgcccggcgccatttgctgcttcattaaaggcattggcataagggtcgatattgatataaaaaaattgcttcttgactaatccgctgatcatcgctgccagctcttcatcttccttggcaattactaaataaggccgtacctgcgcggttgagtctcgcaaccacatcgccggaatgtcccctgtcagtagaaatgttgtgccatcttcatggcgtttgaccgttgtcaacaatgtgttagcaaaagcagcattgaagttttttgcccaatccgcatgttcacttccgcaacgttcggttatttcctgcataaagtttgcaactgaatttggtatttcttgataagccatttggtcaccgtcctaaatttgatatatcattttacgaattcagtataacgatgtttctcagcattgtctagtgaaatttgacaaaactctattttcaattttgaacgaatatgctatcctgtgaatatgatatatcaaaaaaggagatcaactcatgaaagaaccattatacaaaaaaatttatcacgaattgtatgagcagattcaaagcggtgagttagctccggaaagccgtgtccctactgaaaaggaattgtcagagaaataccaagtgagtcgcatcacctccaagcgagccttaactgaattggaacaaaatcagctgatctatcgtattcaaggaagtggcagttttgttcgtagaccgatccaaccacaatcaaaggggaaagtgctgtttattttacccttcgcgaatgacctttcccttggcaattttacggaaggcatctatccagtcatgcaggaacagggattcgaattgatgctgacacctgttgattatctggagcaaaccacggccgaagctttgacagaagaatttgacggaatgatctactacgctaacaacacgaattcaaattatgatctgcttttcgaactggcttcgcaagggttccctgtcgtcacacttgataaagcactgcatgagttctcattcccagctgttttggcagacaactttgaaggaggacagttagcgactgaacatcttttggcacaaggtcatcaacgcattggctatatttttggtgaacgtcaccatccacagtctgtccgccaacgttatctaggctatgtggatcaattaaaaaagcaacagtcgtcttttcgaacaaaacttgatgatcctcaggcacttttgtcatcagctgttagttatattcaagagaatcagttgactggggctgtctgcgagaatgatcttgtcgccatcgaattgatgcgccaattgaaacaagttggggttcaggttccaaaagagtttgctgtgatcggcttcgatgacattcaagcggctgcattggtggatccacctctcagcactgtaaaacaaaattttgccgagttgggtcgtttggctggtacaaaattagtacagttgattcagtcaactgctgccgacttatctccgctcgccaaagaagatgagtctgcaacagcgaatcagaaagtcgcagtcactttagttgtcagagattcaacaattgaccaaaaacaatgacataaaggagcaaacaaaatgaaagtaacaatgatcgatacgaggcatgggacagataatcaatacagcttttctcacggcaactgtctcccttatacaggggttccgtttggcatgaactattttgcccctcaaacaagcgaccaacgtggaagttggtggttccatcctgaagaccgtacgtttcaaggatttcgactgacccatcagccaagcccttggatgggcgattttagtcaccttacttttttgcctattaatgggaagttatcagaaaatacactatttcatgcccaaagttcctatcgtccagaagaaagtgtcttcaatccagcttgtttacaagtgaaaagccaacgctaccaactcactacaacattgatcccaagcatgtacggaggcattctggctctagatggtgcagtgactgatcctggcttaggaatctctttgcctgggcgctatcagctgcagcaagtcgacgaacagaccgtcaaaggacaggtcatcaattactctggttgtgaagacaatgactttgcttttcacttcatcttgcgttttgaaacagctgttcatgcgattgaaggggaattatcaggagaaaatggctttgtggtgattcgttttgaagaaaaaaatcagcaaacgatccgttttgggacatcctttttaagttctcagcaagcctttctgaatctcagccgtgagttggatcaaacaacaactgactacttgtctaatgcgcagcaatcatgggaaaattacttgaatcgaatagatatcaagcaccacgatccaaaacaagtttcaactttttatcataatttttatcggttgtttttattcccacagactttttatgaacgagatcaatctggtcaaaaaatccattacgatacacttgccaagaccatcaaaccaggaccgctttatacaaacaatggtttctgggatacttacaaaacagtctacccactcttttctctgattgcggtcgagcagctagaagatatgttggaaggatttttgaacagctttaaagaaagcggattcttgccaaaatggttatcacctgatgagcgagggctgatgccaggtacattgatcgatgctgtgatcgctgatgcctgcgtcaaaggaattcgacctgacttgatgccagagctcttaacagctatgaagaaagcagcctccattcagagtccaaatccaaattacggccggcaaggaactgccgattacttgaaatacggctatgttcctagtgagtaccatgaatctgtcaatcatacccttgattattgttacagtgatttttgcattgcccaagtggcaagttctctggctgaccctgaagcaagctactatcagcagcaagcaaaaaactatttagcgatctttgattcagaaacaggctttatgcgagcaaaagacaaagccggtgattttcggacggattttgattcctatcgttggggtcgtgattatgcagaagggagtgcgtggcaaagtagctttgctgtgttccatgattttgctggcctgatcgcagctcatggcggcaaacaatcctttgaacaaaaactggtggatttgtgcaatcaagctccccattatactaccgagggctacggttttgagattcatgaaatgagtgaaatggcggctttggattttggtcagttagctatctcgaatcagcctagtttccactatccttatctctttagttacattggcaaaccagaaatggcacaaccattgattaaacaattgctgacccaatgtttcgatgattctccaaaagggtatcctggagatgaggacaatggcagcatgtccggttggtatgtttttaacgcattaggtttctatcctgtcactcctggtaccggcgaatacgttttggggatgcctttgcttgacgaagcgacactctttttgtcgaatggaaaagaacttaaaatccacagcacgccaaatcagccgcagcagcaatttatcgacaatgtgactctaaatggtaaacaacactctcggttgttctttactcatgatgaactgatcgctggttcgacgatccgctatactctaggcatcgttccccgcagtaagacttggtcagcggaagcttatccttatagtctgtcgcatagtcaagagtcgaatgaagaccataatgaaaatcggtaggtaccttttttaaagaacgagcaataccgaaagaaaaaaggttgcgacataaggatcaaccaaactaaactatctgaatgacagtaattgaattgcgcgaggtatttcccacttatggagataccctgctgaccgccggacaattacaacaaccttcagatagtcagtttgttgaagaacttatgttgcagaccttttttgctggttgctcttttgcagctatcaatcaatgaaccgatagcctaaatcgattagatcaatgattagattcctgtaacgccaaaatcagttcaatggttcgcagcacaccattgtcatcattggagcgggtcacaaaagctgcagcttccttgatttcctcaaaagcatttttcattgcaaagctgtaggtgccagcggccattaattcgctgtcattcaatccatccccaaagaccatcgtttcttggggactcactgccagcaaattctgtaattgggctactgttgtccctttatggacaccttgattagtgatatcgatccacgcagcttctgaagcaacgatgtaggcatctgctgcaaaagaagacagctgcttgacgctatcgatacaacgtaacttaggatcatataccgtcactttcacgaagtcttcttggatctcactataactggtgaccgttttgacaacacgataagaacctcgaacccgggctgcattttcttccgttgtcgtttccttgatataagcggctgttggggtacaggcaatgatcacatggtcatctgctattttttctaatcgttggatcaaacgctgccccaatgcatttgggagtaaggattcaaacacatagcctccttgatgtttgattcgtgtggcactatcccctaatatccagattttcgctgcttgatccccaaacagttcttctacgcgctcgcactgcttgccagtacaagcggcaaaggctatccctctttgttccatcatctggctgactttatcaaaataggtttgatcaaaggccccctggctatttaaaaatgttccatctaaatctgtaatgatcagtttgatcatctcattccacatccttcgccgcgtcgctgccgctctatttatttaactaccttaattaaatatacttatttaactgaaaaccgtcaatcgctttaggaactttctttacattgctgcgcttcatcgctatacttaataaactaggttcactaaaggaggcaataacatgtctgccaataaaaacttgattcgccaccagaatattcaagtcgtcttaaaagaattgtttcaaaaagggacctcttttgcatccgatctggtaaaagagaccggcatcagcatggtgacgataaattctttattaaaagatcttgtttcagagggaatggtaacgaaaggcaagctcgttcaaagagagattggacgcccagctatcgaatattgctttaactataagtactcaaaatcattgttgctcgctttgatagaagtaaatcgtcaattggagttgagaagctaccacatcgatttgaaaggaacgatcttagctgcgcagcaccaagctttttccgagatcacaccgacagcctttcagaatcttgtccgacaatctatcgaagctttcgctgatgtcgaacagatcgctgtgctgttgccaggaaaaatcagtgagggtgtcgtgacttccagctggtatgaaaagtttgatggatgggatcttgaccagttattcaaggagattacgcctattccttgcttttatcaaaatgatgcccatttgctgaccgttggccattgtatcgccaagcagatttctctctcggaaaacatcgtaggtatttataatcccgaaaacagcatgccagggatcacgttgatcttcaatgcttctctgttagaaggccaaaatgcgcttgctggagaagcaaaatacttaccaggctttatcgacaaaggtgctccaaaaagtactcaagaattggtggcccgcttatctgctttagtgcctttttataatgctgcttttgctcctgatcgctttgtttttgccagtacagcagcaatagaagaagacttgctagcggctatcactcacgacccttttattaccaaacagccgaatcatcctgtatatacctttgttcacgacttcgaccaagccatgatcttgggtatgcactggctgcttttccgcaataccccctacgatctatcttgctaaacctttccgttgggcattgggagttgcgccaaaaaaacgaacgagtagatctctcctttttgcaggcgaaaagttacgccaaatcaggggatcaccgttcgttttttgtttacgcaacagtaatttcgatcaaattcccttcaggatcttggatcaccgcttcataataaccatcccctgttgtgcggggaccgctcagcagaggaaagccatctgagacaaaacgttgggcataagcatccacttccgcttggcttttcagagccatcgctaagtgcgtgtaacccagtgtatctgttccaccagggtgaaggtgctgctttgtcgttaattcgatacgactgccagaatcaaaacgcaaaaaataagattgaaacccagtcttggtgttgtgatatttttcagaacgttgggcaccaaaatacgtttcataaaattcggccattttttctagatcacgaacccaaatggcaatgtgttccacaaacattgtatccctcttttcgcttttttatgagaagaatccactttacttgtcctttaatcatgcacatccaaattcttctcttattcattgtatcgaagtttcttctttccagcaattttagtcctatcacagagcaatcctctttcttcttatttcctcatattttaagccattacttgaatggtttttctgaaaccagtcgcaatagttgcagttcctcaaaaatttctctaaagtgaaagaaaataagtcatcgatcaaaaaagattctccagtttgcgaaggaggaatgaaaatgaacatcgcaatcatcggtgctggaccacgaggactgtcactatgtgaaaggttgattgctcaagcaagtatcaatcagcagtctctatctctcacattgattgatccctatccccctggaggcgctatttggcaaacgaatcaaccgcaaagtttgctactcaattctgtgaccagtcaagtcaccctttttactgacgaaacgctagaaactggtggcccgatcaaccccggtcccagtctttacgaatgggcaaaaaaagacggtaggaattttgctaaaaaaaatcagccctcactggtatcagaaattgacaagttggatcctgacggtcattgttctcgcgcattatacgggctgtatcagaaatggttttatcagcaattgattgaaacattgcccccattcatcacattcacgtatttgcaggaaaacgccatcggcctaataccgaaacaaacgcactatttactaaaaacagacaggcactctcttcaatcggaccgagtgattctggcagttgggcatcatcaagtctcgctcactgaagaagaagatcgattaaacgaattcgcccgccggaaaggctttttgtattctccgcctcagaatgcagcggatgtcgattttaataaagttaaaggcggagaacacgtcattctccgaggtctaggattggcgttctttgattatgtcacccgtttgaccactgatcgcggcggtgtctttattggttctgatcgccttcgctacattccttctggcaatgaaccaacaatcattgccggatcaggaagaggtttgccataccacgcacgaggagccaatcagaagcatccaacagaacagattctgcctcgcttcttgacaacggaacgactccgctcttggcaagcgaaagggcaagatcagtccactgagtttttcttttatttgcagaaagaaatggaacttgtttattatcaacgctggctgtctcaagagtctgaagatgatcaagcggcttttactgaacaatttgtccaccaaaatggcgccgccgatgttttgacagacttccaaattcctcaccaaaattggttggactggcgctatatcttcgatccttacaaaagaaaagaaagccaatcggttcgcgactttctgttgacctatcttacttgggatgttacagaagcggccaaaggaaatttaacaagtccgatcagtagtatgtttgaattgttaaaagatttgcgtgatccggttcgctttatgcttgatcagcaattgttttcgccaaaagcattaaaagaaaaattctggcagtctttcgttccattgaacgcctttttatcgattggccccccacttcagcgcattcgtgaattgatcgcactgatcgaagcggatatcgtcacgattcttggtccaaagatgatcgttgaagaaagcggcacctttgtggcttattcagccagctatccccaacaacgatacgccgctaagcaggtattggaagctcggattcaatcgacggatattcgtcgtaccgctaatccattgttaagacaattactagctgatggcattgccagtcctcataagttatacattcctaaggaggctccgttttacacaggtgccattgcgcttgatccggccacaagccagttgcttgatccaaatgatcagattcaagaaggactttactgttttggtatcccaacagaaggcattcactggctaaccgccgccacagcacaaccgggaaccaatgcttttaatttacgacaagcagatcagattgctgcccattgcttgactagttctcttcttggggataggcgctgccttcaataaattgcgattgcaaataaaaaccgatacaataaaagaaaaggctcaaggaggttgaaaaatggcagatgaactacaaaagatcgatgcgttgatcaatgaagtcgagaaagtgattttaggaaaacgtgatgtgatccaattaactgtggcggcattattggcaggtggtcacgttttgtttgaagatattcccggagtagggaaaacgatgctagtcaaatcattggcaaaagccatccaaagcgactataagcgtgttcagtttaccccagatcttttgcccaatgatatcttaggtgtatcgatcttcaattcagaaaaccagcaatttgaatttcgaccgggacctatctttacttctgtgttattagcagatgaaatcaatcgcacaacacctcgtacacaagcagcattattggaagcaatgtctgagaatcacgtgaccatcgataatcaaacctacgcgctaagccctcacttctttgtgttggcgactcaaaacccaatcgaatatgaaggaacctatcctttgccggaagcacaactggatcgttttttgtttcgattacacattggctaccctgcttttcaagatgagcttgctttactgattggacaacgccagcaatccctcaatcaaattcagacaatattgacctcgcaggaagttaccgcattgaaacaaatggtcgatcaagttttcgtggacaatcaagttgctcgctatgcgctgcagctggtccaagctagccgcaaccataatgccattgatttaggcatcagccctcgtggcggcattgcctttttgaaaggggcaaaagcattggctttgaccgaaggaagaacctatgtgacaccgcaagacttgcaacgaattttgccagccgtttttggtcatcgcttattattaaaaggcgggattactgccagccaggaaagtctctctgagatcatgaagcaaatgatccaacgcgttcctgtaccagtgaggcgctgatgatgagcaaacagcggttattgggaaaatatctggtattttttgttacttattttcttttactaagctattgtatcgttttcaataatgaagcaggttggagtctcctcttttttgttactttattggtactagcagacttgttattcattctgccttcccttaataaaatccaagtgactcttgaagaatcgatccaaacacaaataaacaaagaaacgcctttgccgctgcaagttttcaagtatcggccaacgctgttgccaatcccaaagctgtctttgctctttcaaaatcaggaacagacgctcactttttatcggggcgaatccatccgcttagaggtgctgtggcttcctaccgctcgaggagcatataatggactgccattgaccctcacaagtcaggaactttggggattcttcagaaaaaggcggcaaatgaaaatccaacaagaaatcctcattttgccagaatatcgacccgaggtcctatccttgatgacactttttgaaaaaaagccgcgaaaatatacttacggggaatcaaatttcaccattcgaaactaccgtaactatcagcaaggggattcattaaagcatattgactggaagctctccagtaaacagcaagaactgatttatcgagaacacgaaacggaacaacaacaggagttgactttgttgttttggggtgaatctcaccctgcttttgaagacacattggcgatcttcttttcgctccaaaatctcttgcttaaaaagatgccttttcagcaactattgatcggcgaggacctggattctccttatcaaatccatgctggagctttcgcagcgattcagccatttatcacagtcccagaaccattgcccaaaatctcagggcgtcaggtgattatcatcacaccggctgtctcgcaatccttagaagactatctggaatccttgacgccaagcaacatgctgcaagtttatacgtatcatgacctgatccaacgactgtcgaacaaagaggtgtctgaatgaatcctttgatcaaaaaagccataatcggagctctgacttacattgcgatcattttgacggtgctgccgtttttagcagtctaccacttggggcaccaaactacgttgcttctgtacgcctttctgatttgctttgtgagtattttaagtcctcgtcttcgctacagtctgcctttttacatcgtaggttggtttgtcactctttaccgcttttttccttatggtgaaggattttccttcacttggttccaaagatatttttatgatttgcaaacagctctcagcgagattctggctggcaaagtcggttatatcactgaacttgttgcagtgaccattatcgtcaccggcattcttctgtttgctgtgttctcgatctacatccagcatttttatattgtctacggtgcaatgtgtctctatctgctgactgtcgtgatttttaatgatttcaatctaacgtggcatttgttgggggtgtgtttttgcggagttctttgcagcctgatcaaaacccaacagctgaaaacagtacgagaatggtcgttctggctggggctcaccctgctatgttcgttgctgttggttggagcaacactgctgccaagaaccgcgattcgcgatcgcttggtagcagctaccactggtatacgcacacaagcgaatcaacgcggcttttatcagtttatcgaagaacatggtgcacctagcgggtcccgtacaggctttagcgaaaatgatcggcaattaggcggtcccttattagacgatgataccgtgttatttacagcccaacaagatacccgccattattggcgagtagaaagcaaagatttttattctggcaagggttggatcaacacgatacgggaagaagatctgcgaacagtgcctgattccctgcggattgcagatgataattatcaacaagattatcttaaagaagaaacagtccagctttatttgcagaatcagggagattatttgccattaccttatggaagcaatcacctcactattgaagaaggagcctctggttttattgtggatgatgcggttcaacgagtcgatctaatggagccgcaacaacagattgaagtttcactggcttggcagccagcggactatgccgctgaaacattgcaatccttgccgctgcaacagccagatactcctgttgactatacacaattacctgagaaccttcctgcacggattcggcagcttgcgcgctcaatcacagaagatcaaagtaccatcttcgaacaagtcacagccattgaaaatcacttgaaaaattcaattgaattccgttattcaaaaacggatgccgtctatccagcagaagaacaagactatgtcgatcaatttttgtttgaatcaaaagttggctattgtgataatttctcgactgcgatggtggtattattacgaacgctcgatattccggcgcgctgggtcaagggtttttcgccaggagatgctcaaactgaaaatggcctgacaacatttaccgtgagaaaccgcaacgcgcattcgtgggcggaagtctattttgccggttttggctgggtaccgtttgagccgacgccgaactttcaaaatcctgatcgtcccgaattgcaaacaacaactgtctcttctgaagtattacctgaaacgagcagttctagtcgcgagtcttctaccagcagcagtagtgagatcagcagttccacaacaacgacggcaactgttgcgccagcagaagaacaccttttctcacctgaaacatggcaatggatccgttcttttctgcaaggtatcgcatgcttggttttcttgggattactgtatcttttgcgccgctactttttccgaattcgcatctggttgattgctcgctttcgttccgaaccattaccaaccgcctatcctgtcttgatgaaacaagcagcaaaagttcttttccatgctgattcggaacctcttagtgagtacgccagccgattggaagctgtttatcctattttccacgggagttttatccaactgacggcaacctatgaagattatctttacggtgggaaaccaatagacggccaacaacagctgattcttcatgtcgcccagcaaatcagtcaattaaagaaaatcaatcaagtccattaaatgaaagcaagaaaaagaaccgaagacgcagtgctgcatgctgcgccttcggttcttattttgttcatctgattagcgaaaacactctcgcaagtatcatgagttcgtgttgttccctcgagattgtaccgctaaaataatcagttttgtgatttccatcatcaagacagcaccagctgccatagctatgcttaacccaacatggttcattgtaaaggtttctggaatcgcaaagacttcccgaattccaggtagcaatgtcacactataaagcagaccacaaaccacgatcgccagccaaaccattttattcgcaaacaatccagcttgccaagcagtctctgtattggaacgagcaggcaatgtttgtaatgtacggctccagatcaaagttgagaatgccattgcaacacctaactccggcgattgattcatcccgatccattgcgctataatcaccactgccgcaatcaagatcccacgataagtaactgagatcagcgttttaccagaaaagatgccagcatcaggatttctaggttctctttgcatgatagttggttccgctttttccatccctaaagcgatagcaggaagcgaatcattcactaagttgataaacagcaattgcaaggctgtaaatggattgtcccagcccattactaaagcaaacacaatggcgataatcgcgccgaggttaccagcaaaaagataagaaatcgcctttttgatattatcaaacacattgcggccaacttctaccgctcgaataattgaagcaaagttgtcatctgtcaagaccattgctgctgcatcttttgcaacgtccgttccggtccccatcgcaatcccgatatccgcttgcttcaatgctggtgcatcatttacgccatcaccggtcatagcagagattttccctttaccttgccatgctcgcacaatgcggattttattctcaggagagacgcgcgcgtagacagtgattttctccaattgattcgtcagttcttcttccgacagtgcatcaagctctgtaccggtcaatgctaagtcaccttcttgcgcaatcccgatctcctgagcaatggccacagccgtcgttttgtggtcaccagtgatcatcactgttttgatgccagccgatttcgcgtctgccacggcttgcttgacttccttccgagggggatcaatcatcgccatcaaaccaacaaagatcaactcttcttcgagacctaaatgcagttcttcgtcttcagacactgtcagcggacgataagcaaaagccaaaacccgcagcgcgcgtttagagaattcttcattttgatgctgcaactgatgtttgatttcctcagtcagtggaacgatttcgtcattgataagaacctttgtacttcttccgatcacaatatccggtcccccttttgtcaaaaggagttgttccgaatcaatggtatgcaatgtggacatcaatttccgatcggaatcaaaaggcaattcttgtaatcgcggatattgttgacgaatctcacgatacggttgattcaatttttctgtataatcaagaaaggcaatctctgtgggatctcctagtttagctccttcgggactgattgccgcatcatttgcaagcacactgatctcgatcaagcgacgttcaggcaatgtccattcagcaggattctcagaaaattcacccgtctgtccatttggcaaataaaaatcaacgaccgtcattttattttgggtcaatgttcctgttttatctgtacaaacaatactagtagaacctagtgtttcaactgccggcaacttacgaatgatcgcatgttgacgagccatttgtttggtaccgatcgataaaacaatcgtaacgatcgattggagtgcttcaggaatagcagccaccgcaacagcgactgcaaacataaaagcgttgactagatcggcggtcatatcgccagacccatcacctaaaaatagccgagcaacttggacacctaaaataatcaaggaaagaacgaggatcgccaagctcaattttttgctgaagcgatccagcccgcgttgtaatggcgtcttgtgttccactgtgttttctaataaaccagcgacttgcccgatttctgtcacatttcctgtggcagtcacaatgaaacggccacggccgtaagtcacgatcgttccactaaagaccatgttatcgcggtctccaataggcgctgtgcggtcaataaccccaagttctttttcagcaggtgtcgattcgccggtcagcattccttcatcgactttcaatgccccttcttcaatcagacggccatcagcaggtacatagtcccctgcttctagaataacgatatcacccactaccaattcttttgccggtaccgtttgttcctttccatctcggataacatttgcattgggtgccgagaggcttttcaatgcatctaacgatccttctgcttttttcgtttggatgacactaacaaccgaattcagtagcaaaacagcaaaaatgacaatcgattcaacatgggcgcccatgatcatctgaacgatagccacgatcagcaaaacgatcaccatcgcatctttgaaggtttctaaaaagagtatcaaacttgattttttgggagcttctttcagctgattcaagccattttctaagcgctttgccgcttcttgctgggacaatccagatggactactgtttacctcgttcataacctctgtgatttctttttgatacatttcttttgccaatgatttctctccttcatagttgctatcccttgcatgagtccttttttagaaaaaaagagacctaagacaagtggatgcttgtcttaggtctcaccatttcatataataccagaaaactgtcgccagtttacttactgttgatattatcgcagccgaagccactggttactcccctaagggtttatcagaatgtagaatcatcataacgaaattttttgaagatagcaacctttatgcacaaatttgtcttttctcagatatatttttttgaaaaaagcttcttttttctgttacactaatctacagcgtaacaagcgtgacagaggaggaacaataatggaaaccattgatttttttacaagtcacacatcggttagagacttccaaaaaaagtctttatcagcagaaatgaagcaacaacttgtcaaagtagcacaaagcggttcaagttcaaatttcgttcaagcctattcaatcatcgagatcaaagatcctaaaagattggcagaaatcgagaaaatcgccggtgctccccactatatcacacagacgggtgtcttttatctgttcgtagcagatttatataaacaccatcaattgttgcagcaagcaaatttgcctagtgctggactatcgaatatggaggccctcttggtttcggttgtagatgccaccatcgccgctcaaaatatggcagcctttgcagaaacccaaggtctgggaatctgttacattggcggaatccggaatgacttgttccgtatcgctgaactcacggagctgcccccgtatacactgccattgtttgggttgactatcggttatcccgcaacgaaaaatgagccgaaagttcgcttaccgcaatccgctgtgttaagcgtcgaccactatcagccactgaccgaagacctcgttgctcgctacaatgaaactaccgcggactactatgcccatcggagaagcaatcaacaaaaaacggattggcaaaccaaaatgactggctttttccaagaacctcgccgtccggacgtagaaaaatttttgaaaatgcaaggctttttgacacagtaagtacgaaaacaagcagctgctccttgttaccggtcgctagactatctccatcaaaaaaacacctcatgaagaagttcttcatgaggtgtttcgagttgttttattttgccaaacggtagatggcatctgcataaatcactgccgcgttgaatagatcatccaagctcataaattcgtttgcttggtgcatcgtatctgtgtagcctgggaacatcgccccatatgcgacaccacgttttaataaacggccataagtgccaccgccaatgatttgttcatagcctttttggccagtatgttcttcataaacttcaagcaatgttttcaccaatggatcatcaattggcacatagtgaggctccatgttgcgctcgttccgagtcactgttgcgccttccatgccaacggttttttcaatgccgatttccagaccttctgcagttaccccttgagggtaacggaaattcaaggcaataaagttgtctgcttgaacacctgattgattagctttaaaagcaaacaaaccagcattcatggttagtttacccattttttcatcttcatgcgccacgcctaatttttcaccataaaaatcttcatggacataagctgccgccgtatggataaattgtcttgcgccgccgccaaaggcaaagttgtctaaaaagactgccaagaaagttcccgcattgatcccagactgaggacttgcaccatgggcgcctttaccgactagttcaatggtaacttcttcattttctgtttcgatggtgccagtcactggttgaccttcgacataatcaaaaaaagctttttccatttctaatgcagcttctgtagacggggcagtcaattttgcaaccgcagttcctggtaccatgttttcccgcaaaccagcagtgaattgttgcagttgataagcaccttcgttatttccttggaaatgaagccctaatgttacattccctttttcgccattgatgattgggaattccgcatcgggagagaaaccaaaatcaggtttttcttcatgctcgaaatagtaatccatatcaccccagccgctttcttcatcagatcctacgacaaagcggatttttttagataatggcaagcctaactctttaatgatcttcattccgtaataagcagccattgaaggacctttatcatcggaagatccgcgagcataaattttattgtctttgatcacaggatcgtagggatctgtcgcccaaccgtcaccagcagggacaacatccatgtggccgaagatccctaatgtttcgtctccttcaccaaattcgatatgtccagcatagttatcgacatttttcacagcgaaaccatcacgttccccataagccaacatgtgcagcaaggcatcacgaggtccaggtccaaacggagcatctgccgttaccttgtcatcttctcgttcactttttactttcaaaagatcaatcaagtcatttagcaaatcgtctttacgcgcttcgacttcttttttccaatcgattgtcatacgattccctccaattcttttctcgccttttatgataacactcttagctgaaaaaaggaaaaaaaattgtgtattttcagacgatatctttcataaaacgagtataataaaagcaataggtttattctagaaaatgagcccagtgaaagaagcagaaaaggagtcattgtatgaagcaactggagcaaactattttagcagcagtgattcgcaaacgccccgtcgaaagtcacaaagggacctttggccgtgccgtagtgattggcggtaaccagcagtacggaggcgcaatcttgatggcggcacaagccagtgtttatggcggaactggactaaccacggtgatctccgatcctgtcaatcgtacggcgctacatgcgcgactgccagaagcgatgttcgtctcttgggaccagactgagcttatcagcacggtcactgaatctgcggatgtcctattgattggcccaggcatgggggaaggcaaaaccagtttcaatctgttgcaaacagtcgtcgctgaacaaaaaagccatcaatggctagttgttgatgggtcagcgatcaatttagctgcgaaatacccattgacttttccttaccccagtcacgtcgtatttacccctcatcaaatggagtggcaacgattaagcggcattgagatcagtgagcaaacaccggagaaaaacacagccttccaaaaaaaattagccagtatcgtggtcttaaaaagccatcgcacccagatttatggcacagaaatcgtcgaaaacccattaggaacgccagctatggccactggcggcaccggggataccttagccgggatcattaccagttttttggcacaatttgatcgaaccgaagaaacggtccacgcagcggtttatctccacagtttgattggcgaacatttagctaccgagaactatgttgtcttgccgacacagatcagtgaagcattgcctaaatttatgaaggaccattcgttgggctgattggcgtaacgaatggtccttttttcttagtgtacttcagaggggtgatatacgatcctgacttcatagggtgccaacgtgattgctcctactagatgttcattggtttccagatcggttactggctgcttcaatactagttgctgttcttcctctgaaaaattcataataaatgaatagtctcgttgcgtcccaactcgcgtttgaatcgacacctcaggaagtgcttcagcaatcgctgttcttctcaatcccaacttttcaatcaacttttgataaaaagcagctaagaaatcactgttcgttcgggcagccaaataatacgaagcccctgcaccgaatggcttcttcgtaaccgcaggcgtgccttgatagaaatctgtctgataatggcttaaaacttctgcatccaacacgtcaatgattgctgaatagtctttggtgacaaatcgctgatcttgaaaatcaatctgattgtgttcgtcttctaaaagtgtttcaagctctaatacctcaatgccaaagagcgcctttaatggttgaggcaatccgccaatataaagcaaatctgtttcattgaccattcctgtgaaatagctggatactagtattccacccttttcaacatagctcgttaattttagcatcgttttttctgtcatcatatatagcattggcgcaatgactaattgataatcagaaaaatcctgctcaggagtcagaatatcaaccggaatgtcttgttcccagaaaacctgataatgctcttgcaacgtttggggataacgtctcgtaggacggccgaatcctcccccgcgcttcaacgcccaattgctttcccagtcaaagagaatcgccacttctttcttgcgagtggttcctttgatttcactgattttttcgagacgagcgccatattcagcaacttctttaaacactcgattgtttgtggaatcatcatgactgacaacggcgccatgaaatttctccgaattgccacgagattggcgccactggaaatacaaggtactatctgacccatgagctaactgctgcatactacttaaaatatggaccccggggcgcttcgatttgtcgtattgttgccaattgacataacttggggtacattccataactaaaaagggttgtttcttcaaagaccaatactgatcatggacataggcagacttcatagcggttgtagcgattgcttcaaagcgattgttccaatcgggataactatcccaactaaccacatccacatactgagaaaacttgccatagtcgattccttccagaggaatgaaatcctgtgtggcatgaccttccgccataaaattcgtcgttactgggatatcaggggttcgttcccgaatagggacaatctcattcaaataaaaatcaatggtctgatcagtgacgaatcgtttccaatccagatccatcccatgaactttatgttctcctaaaggtgatggtggcaagacttgttcccaatcggaatagcgattgccccagaaactcatccaccacgcatgattcaatgcttctaggtttttgtactttttctttaaccagtcacgccaattttcttggcagtattcgcaaaaacattcacccgaatactcattggacatgtgccacatggctagtgccggatggtcgccatagcgttcagctaattttgtgttgatctgccgcactttttcgcgataaattggtgaagaatagcaatgattatggcgaaagccatgggtatgtttttgtccatacgcattggtgcgattgacttccggatatttctgactcaaccactggggacgaccaccgctgggggtagccaaaatgacattgccccccatagcatggatcgcatcaaactgttcatcaagccagtcaaactgatagaccccttctgttggctccaaagcgctccaagcaaacatcccaagtgtgaccgtattgacgtgggctttttgcatatacgccaaatccttctttaggatttccggataatcaagccactgatcgggattatagtccccaccatgcaggaaccgctgatcaaagaaataattcgtcatctttttactcctttttgattgctttgatttgataaacaaatgactggaaatctcctgttacttgcgccgtttggtgattgacagcattgaataagtacggtttgcgcagtccaatttgcttcagaaccttgccagacaactgctcattctccagcagatagcttcgatccagatcaatgaacggtaccggtataaaagcttccgctgcaggatttgcttcagcaagaatccgaaaataggcaatcagtgcttcctcttgatgagagactccccatacaacttcatttttttggctcaaatcggtcatccgatagaaggcgccataagtcagaagttgtcgatgagctttatagaaaatgatttgttctttgattgcttgtttttcagctgctgataaactgaaaagatccagctcgtagcctaatgggccaaacatagccaccgattgccgaaatgccagtgacgtattgcgccccacttgatgattgggacaagcggagacatgattgctgaatgaagacatcggatagccaagtaatgtgccggtttgaatttgtagtcgttccacggcatcgctgtcgtcactcggccaaatctgaggactgtaaaacaagatccctaaatcataacgaccgccgccgccagcacagccttcgatcaaaatctccggaaattctgttaatattttctgataaagggcatagacccctaaaatatagcgatgaaagaattctgtttggggaatcccttcatctgctaaataaggtgaataagcttctgtgatattccgattcatgtcccacttgatataatcaagatccgtttcgacgatgacttttttgatcgcagcaaagattgcctccacgactgccggattggcaaaatctaagacatactggccgcgccccacagagatgcgttcataaggatgtcggaccacccaatcgggatgtttttgataaaactggctgtcaggagagaccatttccggttcaaaccaaacgcctaactgcaaccctagatcgtggatttgttttgcaaaatgaccgatgccattaggaaatttcgctggatctggcacccaatcccctaaagaactgcgatcgttgtctcttttaccaaaccagccatcatctaagacgaagcattccattcctaatgcctgactttctgctgctaatgctactaatttctcttggtcaaaatcaaaataagttgcttcccaattattgaagacaatcggccgcggccgtttttgccaataaggggcaatcacgtgcttttcaataaacgcagcagactcttgccctaacccattcaacccttcatcggtaaatgtcaatatacattctggggcttcaaagactgcatcttgctgcaatgtccaagaaaactgttcgggatgaatccccagcatcaagcgcacattgtcccactcatccatctcgacttgagcgagaaaattccctgaataaatcagatttgctccatagacacgtccctgatcattggtggcattggcagccttcagtgccacgaagggattgtgctgatgcccagaggccccttttaaagaccccactcgaaaggttccttgcgtcaatggtgtggctttgatttggcgttcctttagccaagcaccagaaagatgaacaaattcaaattgctgatttcttaattccagtaccccgctcatcaacgaagaaagttgttttttctcagcgccaagattggtgatccgctgattgcgcgcaatcgtgcctaaaccagcaaaaatagtgtaggtgatttccattttcaattgccgctgctcatcgatcaacattattcgcaggctttggctttctgttttttcggcaaaactcgccggtttggccagctctcgttcctttcctgcgaaagtttcgacttctgcgactttaaaatccacatacaaaggcacgtcttctgcaaaaatagtaacggctccttctcgaaagtcagaagaaccataggttggcaactcttgaaagcgatctgctaacgtaaacaggccatcattttcaaaaaatttgaccgtgccggcagatttattttcttttttggttaaatagtccatgtcattggcactcaaatgccccaaagatggaccaaagtacagatgacctaattgtcgatttggtaaaacatgcatcacataactaatcttttcattgtataaatgaaaaatcgtatcggttattatctcaatcatttttttcctctaatttcaactttattctcgtctatttcattatatttctggcatgcagtttccaaatactgcatgcgttttttgacccctttgttaaaaaagaacttatagaataatgctgccagcatgaaactatacgtattgcgggaacgatcaaaagaattctgttccgaatacgtaacctcaatcttttctgctcccctaggaacaaagcgatacctttgacagatttttccttgttcatagcctgttatcaaagcaacctcatcttgcgcgatttttttgactttcagcaccgctggcaccagcgtggccgctgattttgtgcgaatcatcaaatcaatttgactgttctcgccgaaaggttcttctgctccttttgagcgaaagaatgccgcttgttgtgcgatcatcacttgatagaatcgttccggcgttgtacgcatctgataagtataggtcaatgtatctgttcacatcttcgatcctccattttttcagttgccatgctgacagaacagaatactaagcttagctttctttgattctttcgtcgatggcagggccagtttgtgcgagcgcttctttggctagctcttctttttcttctttcaaatagccacgatccatcacgattaggaatggcacccaaatcaatgtcatcacagcaacagttaccaattgtagaatggcacctgctacagagccagttcccagccagccagataagaagaccggtgtcgtccagactaccgttgctccgattgggcgaggcacaagaccagcagcgattgcaaaataagaaatcgtcgtactagcaagcggggccaaaatccacggaacaaaagcaatcgggttcaatacgatcggcaacccgaatgtcattggctctgacacattgaaaacagatggtgcaatgactgtcttcatcagcttcttcatccgaatcgaacgagcaataaaaaatgccatcgtaatcgagatccctaattgcattccttggtttacaaaaacgcccatgaaggttgtattgatgatatgaggcagttgttctgcacctgctttataggcttcgtagttttcaatcgccaatgcattcatgatcggatcaatcacggcgttaacaaccagtgtgccatggatcccaaaccaccagaagaattgggtgaataaaacggcaatcaagactgcaggcaacgtgccccccaagcccattaatggtttctgtaagatttcgtagacaaagtcgaccgcattgccccatgacgtgaatgtaaacaagtaacggatcaaattaaataaaaacaatggcgcagcacctggaatgatagcaaggaaagactcagcgatcatcggcggaaccgattcaggcattttgatcgttaacccagaagcactgatcttgcaataaatttgtgtagcgataatcgctgtgatgatcccaacgaacatcccttccgcacctaattttgaaaggggaatcactgttcccaggtcatcggaagaaccgtagggcaaaagcattaagaaagaggacaatgagattgctccggcaaaaagttttggctggccatattttcctgccaattgatagccgatcccgaaaacaacaaaaatcgctgtgatactcatggttgcgttcccgataggaccaaagaaatcattcaaaaaggtcatcagtcctgcgggcagtttctcagataagccaaaggtagcgggtaaattttgaataatgatcatgattgaagcaaacattgtcgcgggaaaagcaaccataaagccatcacgcagactcaataaatacttattattggcaatgatttgggcaaaaggaaccatcttctctgctaatttatcaataaatttcataactaatctcctttaatttgtctgtaaacgtttactacaatcagtataattgtttagttaatgtttacacaactctaaaataaaaaaaagatcatttttcatgatctttttttatcggcaatcgattctcttaatatcaattcacttttacaaatcactcggactggcattgttcgaacgcccaataatttgtttttcgccagctctacactcatttgacccatttcttccgctttcattttgactgaagaaagcgctggtgtcataaactgggccatttgaatatcatcaaaactaaccactgatatatcttctgggatcttcaatccgtgttcatttaatgctttatagacccccactgccatgggatcactagcaacgatgatggctgtcggccgtggggtcatctcggcgatttttctgccaaaagctaatccagtctctggagaccattttccttgaaaaacatgactgtattcttccagcttgttcatcagcatccaatttttgtaattctctgcacgaatttcttgttcatcataaacgacttctcctgtgatcgttactcgactggaaacaccaccaataaatgctatgttctcatgtccttttgcttttaagatatccaaaatttgatgggtctttcgagcaaaatcagtttgtatgcaatcataggcgtcgttttcactataattatctaccaaaataatatgttgattgtaccggctgatttcttgcaatgcctcttgcgtcatttccccaatgatgatgacagcaccatactttgccagttgagtcagatctttgtcttggtctcgcatcgagaagacacgaaccgtttttaaacgccatttggctgcctctttctctattccgttacgaatcatcataaaataaggatcattacgctccgattcactgttatgccgtgtaatgattgctatcgtatttttatcgccagcttctcgcgaactcgaaaagctcttgtcttttgaataattcagctggttggcgatctcgatcacccgtttgcgggtattttcgttgatactaaatgtttcatcattgtttaagattcgcgacacacttgcgacggaaacccctgccaattttgcaatatccctcatacttgccattctgccaccccgttgtttactgtttactaaatctctttttaagaatagagagaaacagcgattttgtcaatccctacttgttacgcaagaaaacaggttaggttatcgcgtgcagaaaaatagttgcttcgtgtatgataaaagtagaaataggagggattcagatgaatatcacaacaacacttatgcagcaattggaaaaagacgaaggggaaatgattgcgattcggcggcacttacatcaacacccagagctttcatttcaggaaaaagcaaccgccgcttatatcaaagcctactatgaaaaactagactgccaaatcacagaatgtggcgacggctatggcctgatcgttgatatcatcggtgagcaatgtggaaaacagctggctttacgggccgactttgatgctctggctgtagaagaagacaatcagctgccttttcgatctcaggttcctggtgtgatgcatgcttgtggtcatgatgggcatacggcctatttaatggttttggctaagaatttgattaccttaaaagaccagttaaaaggaagcatccgcatcatccaccaaccagctgaagaagtatctcctggcggtgccaaaggcatgattgccgacggttgtttaacagatattgatcatgtacttggcgtccatgtgatgtcttcaatggaaacaggcaagattggctaccactctggcgaaacccaaactggacgggcaaatttcactttgaccattcgtggcaaaggtggtcatgcttccatgccgcaactagcaaatgatgccatcgtagcaggcagttatttcgttactcaactacagacgatcgtttctcgtcggatcgatccttttgacacagcaagtctaacgattggttcttttgacgggagtggttcctttaatgcaatcaaagagactgtgaccctaaagggagatgttcgtgtgatgaaagaaaccacacgtcaaacgattcaccaacagatccagcgaatggcagagggtctagcacaaacttttgcggttgaaaccagtcttgaatatgatgacaattatccggttctttataatgatccagcttttacaatacaagtgattgattccctcaaagaagctcacttacctgaagtgaaggagatctttgattgcggtcctcaagatccctctgaagacttcgcctactatgcacaagaacgacctagtcttttcttttatatcggttgtatgacagaagatcatctcaatcatcctcaccacagtcctgatttcatgatgaatgaagactgtctcttgattgcagccaaagcggtcggtaccgctacaattgcttatttaatggattagctcctaatcaatgcagttaaaaagagtagtcataagttcccaaaacggcggtccccatcatgcagggtatcgtatcgttttgtctcaacttatgtctactctttttaatgagagatctggattgaagtaatcgaagcaggacagataattaactgaatcaaacaacaaccactcattcccaccaaaaataagtacgccggaccgaagaagccaaaaaacaacaatagcgtaatcgtccaaaaaagatggagcaacactcgtttaggtgagcgaccggcttgataaaaagcataaaagaagctgacttgctgcttcttttcgcccattaaaagcgtctgatagaaaaaaatcaagctacagatcatgaagatcacgatcagcatcgtggccatgacttgaaaaagcggttgtggaaatcgactaagaatggaatgatcaatcaaaagaaaaagactataaaagctgaatacaatatctttctttttattcagttgccacagctcagaaaatttcgtaaagaaaatcgtcgtcgttttctcttgttctgccctctcttgagtgtctttgatctgcttaatcgccgcaatcatacttcttgtcgctgttgccactgtaaaaaaaggcaatgagcaaaccaaccacaaaaattgtagaagaatcaatttgggcatccaattgatccaagtgatcagaccattgaataaacgctgcggctctatctttctcatcctttggttcctcccgtcagatccattccctcaataaagtagcgttgtgcaaaaaagaataataggatcgttggtaataagaccagtgttgcacccgccatcaaatagttccactgtgtcgttgattgattttggaaaacttgcaaaccgatttggagtgtatatttttcttgattttgaatatacagcaatggtcctaagaagtcattccaagcaccattgaatgaattgatggcaatcgtgatcagtgcaggtttggttaaaggaatcatcagatggctccagatatatagatgattggcgccatccatttttgccgcttcaatcagttcattattgatcgataagtaaaattgccgcatcagaaagatattgaaggcattcccaaaaaatgagggaatgatcagcggcagatacgtccctacccagccgattttagaaaacagcacgtattgtggaatcatcgtcacaaatcctggaatcatcattgttgaaaggaccagagaaaaaatcaggtttttccctggaaaatccaacttggcaaatccataagcgataaatgagtttgaaagcacgttgccgaacacaactaacaccgtgataaacaaggtgttctttgcatattgccaaaaaggaaacgcattgatcgtatcaagataatttgagaaattgatttcttctggaaaaaacgttggtggataacggacgatctcttccattggctttaatgaggtgaataccatccacagcaacggaatgatcagaacgatgccaatcacagtcatcactaaataactcgttaactttttgatccgctgctgttgagaattgctctttattttgtacatctgcatacagtcagccctcctgagatagtgtactttgttgaagccatcagttttgtcctcctgcatagtggacccaacgaggagctaatttcagattgataaatgttaaaactaatacgattaagaaaaggatcatcgacatcgccattgcataccccatatcaaaagctacaaacgctttgttccacatatggagattatagaacaagagcgaattggcaggtccaccagtgccgtttttcgtcataacataggcttcttggaagatttggaaagaaccgattgtcgacgtaatgacatcataaaaaataattggtgtaatcaatggaatcgtaatatgtttaaacttagcccacataccagcaccatcgatctctgctgattcataaagcgttccggggatgttctgcaatgtcgccaagtacagcagcatcgcccccccagagctccaaattttcattaggatcaatgccggtttggtccattcaggatcaaacagccaggccggacctttgatgttgaaccagcttaaaaaagtattaatcaaaccagcggaaggcgacagcagctgcatccataacacatatactgccacaccggataaaatcgctggcaaataaaaagtcgtccgaaaaaagctgattcctctaatcttttgattcaataatgtagctagaaagacactgaataaggtcgtcagtgggacattaaagagtacaaaataaattgtattataaagtgatttccaaaaaagtgcatcttgcgtaaacattcgtttgaagtttccaaaaccaataaaattcatttttgacgttagattgtaatccgtaaagctgccgataaacgagaataacatagggcccagcatgaacaccatgaaaccaatcaaaaacggcgctacaaacaaatatccccagagggcatcttgtcttttgcttctcgatcgtttctttttcataattcccctcctttagtaaagtgttttctgccatcttttttcagcaaaatagcaaggatgcaatgagaacagtaacgatagaaaagggaatgcggctagccacaactccctatctcaatctattatttattttgttctacaagatcttccactgctttttgagcatctgctaatccttctgctggttttttattccctagcagaatttgatcaatttgttcattgactaaactgctgaaatctggtgcatccaatggtaccggagtgattactgtattagcaaaattctcatctgccatttgatagatcatttgacctttttcatctaaatgatcatttttgacaagattttcatttgctgttcggttagccataatatcaaagctcttttcaccaaatttttcttgaacttctggggttgaaagatactcgataaacttgtaggacgcttcgggatttttggctccttgaggaacttctaagacaaagccgccaccccatgaccagtgaccagaacctttttctttttctggaatctggatgacgccaaaatcaaagtcatctggcgcattttccatcaagctagagtaataattgatattctgtgcccgcatggccaccaaaccagaaataaatggatctgctacaccggagccaaactcagcttctaaacgattgatcgtatcttgcccataataatcttgccaatcaagaatccaatccagagcctccactttattttctgtgtcaatcgaaaccttttcatctttgtcaaaccaactaacaccgttatcagcgttcaatgcccaaacatccgcgccaaggttccacaaaggatagaatccgatacgctcaaaatcatcgccttttttgacatctaatttgtgtgcaacagtttcaagttcgtcccatgtttggggtaactgatcttcactgatccctgcttctttgaaaatttgtttgttataaaaaatcacttgggtatcggtattgaaaggaattgcataagggtctccttcatattctaccgtatcccataattgaggataaaattcatcagacatgccatctttaacgtactcgctcaagttcgttgcttgctgtgcttctgcacgctgcgcgactgaattgatgtcttgaacaataacatccggtggatttcctgcagtgattgccgagagagacttcgtccaaatatctccccaaggctggtaactatatttcacttcgatttcatcttgtgactgattaaaatcgtcaatgatctcttcgatgacttcttggcgagcccccgatccccaaaaagaccaaaaatctaatgttattttcccatcacttgtctgttttcccgatgcgtcagtatttttgtcttccgaattactgccgcaagccgctgtcaccaatgcggtcgaaaacagcaacagccctattgatagtgcctttttcatcttttatccctgctttcatttttatcattattttataatgttgtaattttaaaatatcatgactcttagtaatgagcaaacaataagcattgtttttttatcaaaaaaaataacgaatttcatagccggagattttttgtagcgttttctttgaaatcttatttattttcaggcatgatagttttagaggatttttcttaagctattgttctcttttttcatttttttatcacttaagaaagaacaatgaaaataaaactacgttttatgaaaaaaagaaagaaggaatcgtcaatgttagttgttattgatatgcagaatcagattcgtgatgaaaatagtcaatcatttatttctgacagcctgctttgatcacgcgaatcgcaaaacggcttcaacaagctcgtgcagaaggtgaatatatcctttttacaagagatatcccgattgattgtaaagatactcctgatgaagaacaagaagcgttacagatcgttcctgaactgcaaccgttaccgaatgaaaaagtaataaaaaaatattactttagtatcccacctgaagttctcttggaaatcaaggagcaacttttcaatgataaaaatgaacaaaaacatatcgaagtgaccggagtagaaaccaacatctgcgtgttgtctaatacgatcgagattcagagtgcttttccagaagccgattttctcattaatcaacagctagtttcaggtagaaaccatgagtcttctggattgaaaatcttacaagacttcaatgtcgaagtggttgatcggacagataactaaaaaagaaacgccaaccacaggcgtttcttttttagttattatgcagtaattcttgcggtatctcgatgcggacatcatttgttgtctgacatgcaggacagacaaaggtgccttcgatcgcatcttttactttaccataatcataatgaatagcgatttcatctgagtgtaactcgttttcttctagaggcggaactgttttcagcttcccatctacatcttcttgcagatgaacaatcaatttgccatcataattttccttgcaattcacacaagatgcttttccacgaatcgtaatatccatgtttttctcctcttttctacttttatgtgagtcctcattggggatacgcttcgatggatgagcccatcgatcctgttttcgatccacctttatagtgtcacgcttgtttagttaaatcaactattctgttttcaactgtcttgccgatcgcaaaaaattcggctggtaaaccttgagcgtttcttttgtcaaaagcattttttcccggcacaattattaagaacacgaattttttgtcatcccaaaagaagaaatggcagtcaatcacacgaccaggaacctttcccgtcacatctcataaaaggaggaacaagtatgcgtgcagtaacatggcaaggaaaagaaaaaatggaagttcgaaatgtgagtgatccgacgatcattgaaccaacagatgcgattattcgagttacagcaacagcgatctgcggctctgatcttcatttgtatcatcacggtggtgcagtactagaagaagggtacgttgttggtcatgaaccaatggggatcgttgaagaagtcggcagtcaagttcaaaaattgaagaaaggggaccgtgttgtcatcccttttaatattggctgtggacattgtcatttttgtcaaaatgagatggagagccaatgtgataactcttctgatcaactttatggtggcctctttggctttggtaagctgaatggcaatcattggggtggacaagcagaattcttacgggttccctttgctgatttcacttcgtttgtcgttccagataccgcgatcccggatgaaaaagtgctttttctatcagacattttgccaactgcctactggagtgtccaaaatgcgggtgtcaaacaaggcgataccgtcattattcttggctcaggacctgtaggactttttgcccaaaagttcgccgttatggctggtgcgaaacgagtgattgcggtcgatccagttgcccatcgactggaaaaggcgcaaagctacaatcaggtagagaccttccaattggatgaccttgcgacaagcgctgatgatttgtatgaattaacaaaaggcggcgccgatgtcatcatcgattgcgtcggtatggatggtttagaacccgtcaaagaaaaagccaaaaatttggtcagcttgcaaagtggtacgatttcaccgatccaaatggcggcgaaagcggtcaaaaaatttggtaccgtgcaaattactggtgtctatatgactccagcatcgtcctaccctttacaagagtttttcatgcgcaatgtggcagtgaaacatggacaagcacccgttatccacttaatgccaaaaatttatgaaatgatccaaaaagaggagatcgacccaacaccgatcatcactcataccatgcctttagaagaagccgctgcggcttatgacatttttgacaaaaaagaagataacaacatcaaagtggtattaaagccaaattaacgcaaagaaaggatgatcgccctcagtgccaaaaatcaaacgaaatgaacatcagatcgaacttggtaaagacgaagacgtcattattaaaggacgccgttttcatgtctatttcaaaaaccggtatctgctgatttccctaacgaatgatattttgactggtttattttatattttcggaagtatcgtgtccttgacagatctgcctgcgatctatggaactatcgcctatctgataggagcaatcttcttaacgatccgaccattgttgaagatcgtccgtcatgtatttatttacaatgaacggaaacaaaatggagagaaagaaaagaatatcgaagtatccgatgatggtgaataaacagtgacgattttcttcaagcagtatttttcccaaaacaaaacacatgctatatactataaatatgcacaaagaaaggagaattctaaaatgaaagtattagacagtatagctttagcgctacttatcgttggcggcctaaactggttattggttggactatttgaatttgacttggttgcaacaattgcgggcggatcaactacattattcgctaaaatcatttacgtaattgtcggtatctgcgcgatttattgcttgaagttctttgttggtattgctcgtcaagacaacgtgaaccgataatcattgataaataaaaagcaagaaacgaatgatctgatccatagttgctctactttctatggatcagatctttttgtttgcattgccttttgtctctttttttatttgttgtataattagtgtcaacagcgaattaaaaaatttagataaatagattttggctggactaggaatagcagctcattcacaatgaaccgacaaaggaagtgacccatgactgataaaaaacgtaactccaagcttctcccttctctgcttttttatttcatcctcctgctcatcattgcaggaatcttagggatcgttgtactgacgaacatcaatattgccgaaaactggtttggactggatgagtacacagttgtagaaactcgcgaccaagtgatcggctatcttccgctactctggtacttcgttatagcactaatgatagtcttggcattattttttggtatcagaaaaagaaaaagggctttgttctattggatcggcacattggtcattctccctagcatcttgttagcatttggtgctttaacaaccttgctacccttcgaccgaaatttttttagagaagaagcctctgcttccgcgatcatggctgaattaaccgacaaaaaagcgctgaaagatcaagaggttcagctcatcagttatagctatcacattcggaacattcctttgaaaagcggcgtctatgcagtcgcgcgaatcatcaaccctaccactaaactacaagatgaatactggtattattcgacaaatcttttacaaaaatggcagaaagacagtgatacgatcgagttacctattcaagagaccattgcttataatgaaatcgattggggcgttattcccaaggttatcaaagaaacggaaaaacgggttgcgaaattagaccattattatcccggagttagtatcgtgatcttaaatggttctcaaggcaaatggacttggacggtcggtgtcgatgatattcggggacatactgcactgaatctggtttatgatctttcaggaaattatctttctcaatgggattaatcggtcaatacaggccctacttccatcatttattaagacagcaattaaacaaaaaactatctaagcgatcactgattgttcctatcaaaggacgacttgctaaaaaaagcaatgagacaatcaagattttttagatagtttttttattattattcacagatacgcctagcttttggcacagcgaaagcctaaattattggccgcagacatcccggagtttccattgcgggctgcgatccgataacgtttgcagtaagattcatgacacaagaacgaccctccccgtgtcgcatacatggcatcatccacctgctgaaatcgttgctcaaaaaaatggctgtcccatgaacgaaattgttccaatggtatccttgcgggattgctgcaccattcccacacattgccaatgacttgataaagtccatagccattcggctcataaaaccgagcaggtgcagtactcgcaaagccgtctgccttcgtatttgctttgggaaacgcgccttgccagatgttgcagtgatagtcttctccagctaaaaaatctgtcccccatggatataagtcattctctgtaccacctttcgcggcaatctcccattcagcttctgttggcagccgcttatctgcccagcggcaaaatgccaacg

(The sequence listing continues in the following parts.)

The invention claimed is:

1. A pharmaceutical composition that comprises:
   a lyophilized *Enterococcus gallinarum* bacteria strain deposited under NCIMB 42761; and
   a pharmaceutically acceptable excipient, diluent, or carrier.

2. The pharmaceutical composition of claim 1, wherein the lyophilized *Enterococcus gallinarum* bacteria strain is present in an amount of at least $1\times10^3$ CFU/g of the lyophilized *Enterococcus gallinarum* bacteria strain with respect to a total weight of the pharmaceutical composition.

3. The pharmaceutical composition of claim 1, wherein the lyophilized *Enterococcus gallinarum* bacteria strain is present in an amount of from about $1\times10^6$ to about $1\times10^{11}$ CFU/g of the lyophilized *Enterococcus gallinarum* bacteria strain with respect to a total weight of the pharmaceutical composition.

4. The pharmaceutical composition of claim 1, further comprising a lipopolysaccharide.

5. The pharmaceutical composition of claim 1, wherein the pharmaceutical composition is formulated for oral delivery.

6. The pharmaceutical composition of claim 1, wherein the pharmaceutical composition is formulated for rectal delivery.

7. The pharmaceutical composition of claim 1, wherein the pharmaceutical composition comprises an enteric coating.

8. The pharmaceutical composition of claim 1, wherein the pharmaceutical composition is a solid dose composition.

9. The pharmaceutical composition of claim 1, wherein the pharmaceutical composition only contains the lyophilized *Enterococcus gallinarum* bacteria strain and the pharmaceutically acceptable excipient, diluent, or carrier.

10. The pharmaceutical composition of claim 1, wherein the lyophilized *Enterococcus gallinarum* bacteria strain is live.

11. A vaccine comprising the pharmaceutical composition of claim 1.

12. A method of treating a cancer in a subject in need thereof, comprising: administering to the subject a therapeutically effective amount of a pharmaceutical composition that comprises *Enterococcus gallinarum* bacteria strain deposited under NCIMB 42761.

13. The method of claim 12, wherein the *Enterococcus gallinarum* bacteria strain is lyophilized.

14. The method of claim 12, wherein the pharmaceutical composition further comprises a pharmaceutically acceptable excipient, diluent, or carrier.

15. The method of claim 12, wherein the cancer is a solid tumor cancer.

16. The method of claim 12, wherein the cancer is a lung, liver, colon, breast, ovarian, prostate, pancreatic, testicular, thyroid, renal, gallbladder, or gastric cancer.

17. The method of claim 16, wherein the cancer is a breast cancer, and wherein the breast cancer is mammary carcinoma or stage IV breast cancer.

18. The method of claim 12, wherein the *Enterococcus gallinarum* bacteria strain is live.

19. The method of claim 12, wherein the pharmaceutical composition comprises an enteric coating.

20. The method of claim 12, wherein the subject has cancer.

21. The method of claim 12, wherein the subject has previously received treatment for cancer.

22. The method of claim 12, wherein the therapeutically effective amount comprises at least $1 \times 10^3$ CFU/g of the *Enterococcus gallinarum* bacteria strain with respect to a total weight of the pharmaceutical composition.

23. The method of claim 12, wherein the therapeutically effective amount comprises from about $1 \times 10^6$ to about $1 \times 10^{11}$ CFU/g of the *Enterococcus gallinarum* bacteria strain with respect to a total weight of the pharmaceutical composition.

24. The method of claim 12, wherein the administering is an oral administering.

25. The method of claim 12, wherein the administering is a rectal administering.

* * * * *